US011339387B2

(12) United States Patent
Puckette et al.

(10) Patent No.: US 11,339,387 B2
(45) Date of Patent: May 24, 2022

(54) MODIFIED FOOT-AND-MOUTH DISEASE VIRUS 3C PROTEASES AND METHODS FOR PROCESSING FMDV P1 PRECURSOR POLYPEPTIDE

(71) Applicant: The Government of the United States of America, as represented by the Secretary of Homeland Security, Washington, DC (US)

(72) Inventors: Michael Puckette, Waterford, CT (US); John Neilan, Wethersfield, CT (US)

(73) Assignee: The Government of the United States of America as represented by the Secretary of Homeland Security, Washington, DC (US)

( * ) Notice: Subject to any disclaimer, the term of this patent is extended or adjusted under 35 U.S.C. 154(b) by 0 days.

(21) Appl. No.: 15/986,214

(22) Filed: May 22, 2018

(65) Prior Publication Data
US 2019/0359964 A1    Nov. 28, 2019

(51) Int. Cl.
*C12N 9/64* (2006.01)
*C12N 15/52* (2006.01)
*A61K 39/135* (2006.01)

(52) U.S. Cl.
CPC .......... *C12N 9/6472* (2013.01); *A61K 39/135* (2013.01); *C12N 15/52* (2013.01); *C12N 2770/32034* (2013.01); *C12Y 304/22028* (2013.01)

(58) Field of Classification Search
CPC ....................................................... C12N 9/64
USPC ........................................................ 435/226
See application file for complete search history.

(56) References Cited

U.S. PATENT DOCUMENTS

| 4,748,018 | A | 5/1988 | Stolle et al. |
| 8,236,548 | B2 | 8/2012 | Chen et al. |
| 8,846,051 | B2 | 9/2014 | Kew et al. |
| 10,308,927 | B2 * | 6/2019 | Puckette ................. C12N 7/00 |
| 10,385,319 | B2 * | 8/2019 | Puckette ............ C07K 16/1009 |
| 2018/0066235 | A1 | 3/2018 | Puckette et al. |

FOREIGN PATENT DOCUMENTS

WO    2018048652 A1    3/2018

OTHER PUBLICATIONS

Puckett et al., Foot-and-Mouth Disease (FMD) Virus 3C Protease Mutant L127P: Implications for FMD Vaccine Development. Journal of Virology. Nov. 2017 vol. 91 Issue 22 e00924-17.*
USPTO in house BLAST with SID8; Ali et al., polyprotein, partial [Foot-and-mouth disease virus—type O]. Alignment with SID8.*
Genbank Accession No. AAX81555.1, 3C proteinase, partial [Foot-and-mouth disease virus—type SAT 2], Jul. 26, 2016 [online]. [Retrieved on Dec. 3, 2018]. Retrieved from the internet: <URL: https://www.ncbi.nlm.nih.gov/protein/AAX81555.1>.
International Search Report and the Written Opinion of the International Searching Authority for PCT/US2018/051974 dated Feb. 8, 2019.
Luke et al., "2A to the fore-research, technology and applications", Biotechnology and Genetic Engineering Reviews, 26(1), p. 223-260 (2009).
Vriend, G., "What If: a molecular modeling and drug design program", Journal of Molecular Graphics, 8(1), p. 52-56 (1990).
Thompson et al., "Clustal W: improving the sensitivity of progressive multiple sequence alignment through sequence weighting, position-specific gap penalties and weight matrix choice", Nucleic Acids Research, 22(22), p. 4673-4680 (1994).
Heffernan et al., "Highly accurate sequence-based prediction of half-sphere exposures of amino acid residues in proteins", Bioinformatics, 32(6), p. 843-849 (2015).
Jones, D. T., "Protein secondary structure prediction based on position-specific scoring matrices", Journal of Molecular Biology, 292(2), p. 195-202 (1999).
Kay et al., "A robust system for production of minicircle DNA vectors", Nature Biotechnology, 28(12), p. 1287-1289 (2010).
Puckette et al., "Evaluation of Gaussia luciferase and foot-and-mouth disease virus 2A translational interrupter chimeras as polycistronic reporters for transgene expression", BMC Biotechnology, 17(1), p. 52 (2017).
Puckette et al., "Foot-and-mouth disease (FMD) virus 3C protease mutant L127P: implications for FMD vaccine development". Journal of Virology, 91(22), e00924-17 (2017).

(Continued)

*Primary Examiner* — Sheridan Swope
(74) *Attorney, Agent, or Firm* — Lavanya Ratnam; Kelly G. Hyndman; Robert W. Busby

(57) ABSTRACT

The disclosure is directed to an isolated polynucleotide encoding a modified picornavirus 3C protease, wherein the modified picornavirus 3C protease includes an altered secondary structure and one or more amino acid substitution(s) located at one or more amino acid position(s) corresponding to positions 16-25, 99-100 and 115-130 of a wild-type Fool-and-Mouth Disease Virus (FMDV) 3C protease, wherein the isolated polynucleotide encoding the modified picornavirus 3C protease, when transformed into and co-expressed in a host cell, enhances transgene expression of a P1 precursor polypeptide in comparison to an amount of P1 precursor polypeptide transgene expression exhibited in a host cell transformed and co-expressed with a control picornavirus 3C protease, wherein the one or more corresponding amino acid position(s) is/are identified by an alignment of the modified picornavirus 3C protease with the one or more of the wild type FMDV 3C protease(s). Methods for processing a picornavirus P1 precursor polypeptide into picornavirus viral proteins and/or virus-like particles using the isolated polynucleotides are also provided.

20 Claims, 27 Drawing Sheets
Specification includes a Sequence Listing.

(56) References Cited

OTHER PUBLICATIONS

Yang et al., "Production and characterization of two serotype independent monoclonal antibodies against foot-and-mouth disease virus", Veterinary Immunology and Immunopathology, 115(1-2), p. 126-134 (2007).

Stave et al., "Analysis of foot-and-mouth disease virus type O1 Brugge neutralization epitopes using monoclonal antibodies", Journal of General Virology, 67(10), p. 2083-2092 (1986).

Birtley et al., "Crystal structure of foot-and-mouth disease virus 3C protease new insights into catalytic mechanism and cleavage specificity", Journal of Biological Chemistry, 280(12), p. 11520-11527 (2005).

Zunszain et al., "Insights into cleavage specificity from the crystal structure of foot-and-mouth disease virus 3C protease complexed with a peptide substrate", Journal of Molecular Biology, 395(2), p. 375-389 (2010).

Yang et al., "Crystal structure of the 3C protease from Southern African Territories type 2 foot-and-mouth disease virus", PeerJ, 4, e1964 (2016).

Mosimann et al., "Refined X-ray crystallographic structure of the poliovirus 3C gene product1". Journal of Molecular Biology, 273(5), p. 1032-1047 (1997).

Kawatkar et al., "Design and structure-activity relationships of novel inhibitors of human rhinovirus 3C protease", Bioorganic & Medicinal Chemistry Letters, 26(14), p. 3248-3252 (2016).

Wang et al., "Crystal structures of enterovirus 71 3C protease complexed with rupintrivir reveal the roles of catalytically important residues", Journal of Virology, 85(19), p. 10021-10030 (2011).

Lee et al., "Structural basis of inhibition specificities of 3C and 3C-like proteases by zinc-coordinating and peptidomimetic compounds", Journal of Biological Chemistry, 284(12), p. 7646-7655 (2009).

Bergmann et al., "The refined crystal structure of the 3C gene product from hepatitis A virus: specific proteinase activity and RNA recognition", Journal of Virology, 71(3), p. 2436-2448 (1997).

Martel, Erica et al., "Effect of foot-and-mouth disease virus 3C protease B2 [beta]-strand proline mutagenesis on expression and processing of the P1 polypeptide using a plasmid expression vector", Journal of General Virology, vol. 100, No. 3, Mar. 1, 2019, pp. 446-456, XP055668860.

"Foot-and-mouth disease virus—type A isolate IND 64/2004, complete genome.", XP002797799, May 15, 2011, retrieved from EBI accession No. EMBL:HQ832581.

Partial European Search Report and Provisional Opinion for EP application No. 18842766.0 dated Mar. 6, 2020.

Database EMBL [Online], "Foot-and-mouth disease virus—type SAT 2 isolate SAT2/KEN/03/57 P2/P3 polyprotein gene, partial cds.", XP 055701488, retrieved from EBI accession No. EMBL:KJ144915 Database accession No. KJ144915, sequence, Apr. 14, 2014.

Database EMBL [Online], "Foot-and-mouth disease virus—type O polyprotein ID-ATO74535, SV 1; linear; genomic RNA; STD; VRL; 6999 BP.", XP055701503, retrieved from EBI accession No. EMBLCDS:ATO74535, sequence, Dec. 5, 2017.

Database EMBL [Online], "Ovine hungarovirus OHUV1/2009/HUN polyprotein ID—ADO85550; SV 2; linear; genomic RNA; STD; VRL; 6759 BP.", XP055701522, retrieved from EBI accession No. EMBL:ADO85550, sequence, May 1, 2011.

Database EMBL [Online],"Coxsackievirus B1 polyprotein ID—ABV64405; SV 1; linear; genomic RNA; STD; VRL; 6552 BP.", XP055701543, retrieved from EBI accession No. EMBL:ABV64405, sequence, Oct. 1, 2007.

Database EMBL [Online],"Coxsackievirus B3 polyprotein ID—AAG23918; SV 1; linear; genomic RNA; STD; VRL; 6558 BP.", XP055701568, retrieved from EBI accession No. EMBL:AAG23918, sequence, Oct. 18, 2000.

Extended European Search Report for EP application No. 18842766.0 dated Jun. 16, 2020.

* cited by examiner

FIG. 3

```
       αN              A₁              B₁              C₁              D₁    E₁
       10              20              30              40              50              60
SGAPPTDLQK  MVMSNIKPVE  LILDGKTVAI  CCAIGVFGTA  YLVPRHLFAE  KYDRIMLDGR
  E₁      E₁      E₁       F₁      F₁                                              A₂
       70              80              90             100             110             120
AMTDSDYRVF  EFEIKVKGQD  MLSDAALMVL  HRGNRVRDIT  KHFRDTARMK  KGTPVVGVIN
        B₂              β-ribbon        C₂              D₂              E₂
       130             140             150             160             170             180
NADVGRLIES  GEALTYKDIV  VCMDGDIMPG  LEAYRAATKA  GYCGGAVLAK  DGADIEIVGT
  E₂      F₂       αC
       190             200             210
HSAGGNGVGY  CSCVSRSMLL  KMKAHIDPEP  HHE
```

```
                                          I22 L23
    FMDV Asia 3C(wt)    1  sqgpptdlq-kxvmsntkpvelildgktvaioocetgvfgtaylvpchlfaekydrixldgramtdedyrv
Coxsackievirus A16 3C(wt) 1  --gpsldfelsllrrnirqaqndqghftm-----lqirdnlallprh--sgpgktiviehklv------ov
 Coxsackievirus A1 3C(wt) 1  --gpvfdya--vamakknilnatrekgeftxl-----gvhdrvevlpth--snpgetivvsgk------evki
       Key Structures     [N-term helix]  [A,β]

I99 T100              V124  L127
                                                         I119 N121
    FMDV Asia 3C(wt)   70 fefeikvkgqdmladsalsvlhngnrvndiukhfrdtermkkgupvvgvinnadvgxlifs-geeltykd
Coxsackievirus A16 3C(wt) 57 idavelvdeqgvnleltlvtldtmekfrditkflpec---iagaedativinteluupesfvplgdrvqyg-
 Coxsackievirus A1 3C(wt) 57 idakelvdndevnleltlvtldxnekfrdirthl--ptqihetndavlavntskfpsmyip-vgavvegg
       Key Structures                   [F,β]           [A,β]  [B,β]

Y162 C163
    FMDV Asia 3C(wt)  139 ivvcxdqdtspglfeyreetkagycggevlakdgadtfivgchaaggngvgycscvcrsmllkmkahldp
Coxsackievirus A16 3C(wt) 124 -flnlagkpthrcmmynfptkegqcggvvtevgk----ligiblqgngrqgfcaglkrsyfeseq------
 Coxsackievirus A1 3C(wt) 124 -mlnlggrptnrtlneynfpckagqcggvlmatqk----vigihvggngshqfaxelkrayfteeq-----

FMDV Asia 3C(wt)  208 spthe
Coxsackievirus A16 3C(wt)     -----
 Coxsackievirus A1 3C(wt)     -----
```

FIG. 6

```
                                            I22 L23
FMDV Asia 3C(wt)    1  sgapptdlq-kmvmsntkpvelildgktvaiccatgvfgtaylvprhlfaekydrimldg
Enterovirus A71 3C(wt) 1  --gpsldfalsllrrnirqvqtdqghfts------lgvrdrlavlprh--sqpgktiwieh
Key Structures         [N-term helix] [A₁β]

I99 T100                    I119
FMDV Asia 3C(wt)   60  ramtdsdyrvfefeikvkgqdmledealmvlhrgnrvrditkhfrdtarmkkgtpvvgvi
Enterovirus A71 3C(wt) 52  klv------nvldavelvdeqgvnleltlitldtnekfrditkfipe--aistasdativi
Key Structures                                           [F₁β]                      [A₂β]

V124 L127                        Y162 C163
                    N121
FMDV Asia 3C(wt)  120  nhadvgrlifs--gealtykdivvcmdgdtmpglfayraatkagyuggavlakdgsdtfiv
Enterovirus A71 3C(wt) 105  ntehmpsmfpvgdvvqyg--flnlagkpthrtmmynfptkagqcggvvtsvgk-----vv
Key Structures         [ ][B₂β]

FMDV Asia 3C(wt)  179  gthsaggnqvgycacvsrsmllkmkahidpephhs
Enterovirus A71 3C(wt) 159  gihiggngrqgfcaglkrsyfasq-----------
```

|                      |     |                                                                              |
|----------------------|-----|------------------------------------------------------------------------------|
| FMDV Asia 3C(wt)     | 1   | sgapptdlqkmvmantkpvelildgktvaiccatgvfgtaylvpchlfsekydrimldg-                  |
| Rhinovirus A2 3C(wt) | 1   | --gpeeefgmslikhnscvittengkftgl----gvydrfvvpth---adpgkeiqvdg-                  |
| Rhinovirus 89 3C(wt) | 1   | --gpeeefgrslikhnccvvctdkgkftgl----giydqvmvlpth---adpgseilvdg-                 |
| Rhinovirus 20 3C(wt) | 1   | --gpqeefgrslikhntcvvctdngkftgl----giydnimiipthadagk---eveldgi                 |

Key Structures: N-term helix | A,β

I22 L23 (positions marked)

|                      |     |                                                                              |
|----------------------|-----|------------------------------------------------------------------------------|
| FMDV Asia 3C(wt)     | 60  | ramtdsd-yrvfefe-ikvkqqdmlsdaalmvlhrgnrvrditkhfrdtarmkkgtpv---                 |
| Rhinovirus A2 3C(wt) | 52  | itckvid------syd-lynkmgikl-eitvlkldrnekfrdirryipnneddypnon----                |
| Rhinovirus 89 3C(wt) | 52  | vkvkvsdsydlhnhegvki--------eitvvklirnekfkdirkyl----pareddypacs                |
| Rhinovirus 20 3C(wt) | 53  | ktqvdda-ydlh--------nsqqikleitvlklhrnekfrdirkyipet---eddypech                 |

Key Structures: F,β ... A2,β

I99 T100 (positions marked)

V124 L127
I119 N121
Y162 C163

|                      |     |                                                                              |
|----------------------|-----|------------------------------------------------------------------------------|
| FMDV Asia 3C(wt)     | 116 | vgvinnsdvgrlifsgealtykdivvcmdgdtmpglfayrastkagycggavlakdgadt                  |
| Rhinovirus A2 3C(wt) | 102 | lallsnqpeptiinvgdvvsygnll--lsgnqtarmikysyptksgycgg-vlykigq--                  |
| Rhinovirus 89 3C(wt) | 102 | lallsnqdeptiisvgdavsygnll--lsgtntarmikyhyptksgycgg-vlykvgs--                  |
| Rhinovirus 3C(wt)    | 102 | lalvsnqqeptilevgdccsygnll--lsgnqtarmikynyptksgfcgg-vlykig---                  |

Key Structures: A,β | B,β

|                      |     |                                                   |
|----------------------|-----|---------------------------------------------------|
| FMDV Asia 3C(wt)     | 176 | fivgthsaggngv-gycscvsrsmllkmkshidpephhe            |
| Rhinovirus A2 3C(wt) | 150 | -vlgih-vggngrdgfsamllrsyftdvq---------             |
| Rhinovirus 89 3C(wt) | 150 | -ilgih-vgngrdgfsamllkeyfgetq---------              |
| Rhinovirus 3C(wt)    | 156 | lvlgih-vggngrdgfsamllrsyfteqq---------             |

FIG. 10

```
                                                    I22 L23
                                                     ||
FMDV Asia 3C(wt)    1  sgapptd--------lqkmvmsntkpvelildgktvaiccatqvfgtaylvprhlfaekydri
Rhinovirus B14 3C(wt) 1  ---gpntefalellrknimtitts--------kqeftgl-----gihdrvcvipth---aqpgddv
Key Structures         [  N-term helix  ]    [ A₁β ]

I99 T100
                                                               ||
FMDV Asia 3C(wt)   56  mldgramtdsd-yrvfefeikvkgqdmlsdaalmvlhrgnrvrditkhfrdtarmkkgtp
Rhinovirus B14 3C(wt) 48  lvngqkirvkdkykl-------vdpeninleltvltldrnekfrdirgflsedl----egvd
Key Structures                                                 [F₁β]              [ ]

V124  L127                                      Y162 C163
                       |     |                                          ||
                I119 N121
                  ||
FMDV Asia 3C(wt)  115  vvgvinmadvgrlifsgealtykdivvcmdgdtmpglfayraatkagycggavlakdgad
Rhinovirus B14 3C(wt) 99  atlvvhsomftntilevgpvtmaglinlsstpt-srmirydyatktgqcgg-vlcatgk-
Key Structures         [A₂β] [B₂β]

FMDV Asia 3C(wt)  175  tfivgthsaggng-vgycscvsrsmllkmkahidpephhe
Rhinovirus B14 3C(wt) 156  ---ifgih-vggngrqgf--------saqlkkqyfvekq-----
```

FIG. 11

```
                                                    I22 L23
FMDV Asia 3C(wt)    1  agapptdlgkmvmentkpvelildgktvai---ccatgvfgtaylvprhlfaekydrixl
Hepatitis A 3C(wt)  1  ----stleiaglvrknl---vqfgvgekngcvrwvmnalgvkddwllvpshaykfekdyemm
Key Structures         [N-term helix]  [A₁β]

I99 T100
FMDV Asia 3C(wt)   58  d----gramtdadyrvfefeikvkgqdm--lsdaalxvlhrgnrvrditkhf---rdtar-m
Hepatitis A 3C(wt) 56  efyfnrggt--yysisagnvviqsldvgfqdvvlmkvptipkfrditqhfikkgdvpral
Key Structures                                                         [F₁β]

V124   L127
                       I119 N121
FMDV Asia 3C(wt)  110  kkgtpvvgvinhadvgrlifsg------ealtykdivvcmdgdtmpglf---ayraatka---
Hepatitis A 3C(wt)114  nrlativttvngtpm--lisegplkmeekaty--vhkkndgttvdltvdqawrgkgeqlp
Key Structures                [A₂β]  [B₂β]
                   Y162 C163
FMDV Asia 3C(wt)  189  gycggavlakdga-dtfivgthsaggngvgycscvsramllkmkahidpephhe
Hepatitis A 3C(wt)170  gmcggalvsanqsiqsailgihvaggnsilvaklvtqemfqnidkkiesq----
```

FIG. 12

| | | |
|---:|---|---:|
| FMDV Asia 3C(wt) | 95 rvrditkhf | 103 |
| Coxsackievirus A10 3C(wt) | 82 kfrditkfi | 90 |
| Coxsackievirus A1 3C(wt) | 82 kfrdirthl | 90 |
| Polio 1 Mahoney 3C(wt) | 82 kfrdirphi | 90 |
| Polio 3 3C(wt) | 82 kfrdirqhi | 90 |
| Polio 2 3C(wt) | 82 kfrdirphi | 90 |
| Human Rhinovirus A2 3C(wt) | 82 kfrdirryi | 90 |
| Human Rhinovirus 89 3C(wt) | 82 kfkdirkyl | 90 |
| Human Rhinovirus 20 3C(wt) | 82 kfrdirkyi | 90 |
| Human Rhinovirus 14 3C(wt) | 82 kfrdirgfi | 90 |
| Human Enterovirus A71 3C(wt) | 82 kfrditkfi | 90 |
| Coxsackievirus B3 3C(wt) | 82 kfrdirgfl | 90 |
| Coxsackievirus B1 3C(wt) | 82 kfrdirgfl | 90 |
| Hepatitis A 3C(wt) | 95 kfrditqhf | 103 |
| Equine Rhinitis A 3C(wt) | 95 kvrnivhlf | 103 |
| Bovine Rhinitis B 3C(wt) | 92 rvrditshf | 100 |
| Bovine Rhinitis A 3C(wt) | 91 rvkdmtmhf | 99 |

US 11,339,387 B2

MODIFIED FOOT-AND-MOUTH DISEASE VIRUS 3C PROTEASES AND METHODS FOR PROCESSING FMDV P1 PRECURSOR POLYPEPTIDE

SEQUENCE LISTING

The instant application contains a Sequence Listing, which has been submitted via EFS-Web and is hereby incorporated by reference in its entirety. The ASCII copy, created on May 20, 2018, is named DHS-0162_ST.25.txt, and is 1,892 kilobytes in size.

FIELD (21 The present disclosure relates to modified picornaviruses 3C proteases. The modified picornaviruses proteases exhibit reduced cytotoxicity when expressed in host cells.

BACKGROUND

Picornaviruses, which include genera such as Aphthovirus (e.g., Foot-and-Mouth Disease Virus (FMDI)), Enterovirus (e.g., polio and rhinoviruses) and Hepatovirus (Hepatitis A virus (HAV)) have a major impact on the health of humans and animals. While some infections may be mild, many picornaviral strains cause serious disease and substantial economic burden.

Structurally, picornaviruses are non-enveloped RNA viruses characterized by a capsid surrounding a core of single-stranded genomic RNA. The genomic RNA contains one open reading frame, which is translated into a large polyprotein that is subsequently cleaved into structural and nonstructural proteins by viral-encoded proteases. Those structural proteins that are used to assemble the capsid are ultimately derived from an intermediate cleavage product, P1 (also known as P1-2A).

Subunit vaccines against various picornaviral strains using only the assembled capsid (Virus-Like Particles or VLPs) are presently under development. These multiprotein structures, which may be recombinantly expressed in a host cell, mimic the organization and conformation of authentic native viruses, but lack the viral genome. Consequently, such vaccines, which contain only a portion of virus, are less likely to result in accidental outbreaks during manufacturing than, e.g., the more commonly used inactivated whole live viral vaccines.

Despite the potential safety of picornaviral subunit vaccines comprising VLPs, such structures may be difficult to obtain from host cells. For example, cytosolic expression of a picornavirus 3C protease (or $3C^{pro}$), or the fusion protein of $3C^{pro}$ with the 3D polymerase (or 3CD), is typically required to process the P1 polyprotein into the individual structural proteins that assemble into the capsids. However, the use of $3C^{pro}$ or 3CD in a host cell can cause proteolysis of a variety of host proteins, including those associated with cell survival. Accordingly, expression of wild-type $3C^{pro}$ or 3CD in host cells can restrict vaccine production platform options and reduce antigen yields.

Recent reports describe FADV 3C protease mutants that mitigate detrimental effects on host cells, such as *E. coli*, while maintaining the ability to process recombinant FMDV P1 polyprotein. However, no other picornavirus 3C or 3CD protease mutants with these properties have been described. Furthermore, new FMDV 3C protease mutants are desirable since these may provide additional benefits in *E. coli*, mammalian host cells or other expression systems. Consequently, there is a desire for additional picornavirus 3C or 3CD protease mutants that facilitate the expression of picornavirus 3C protease in host cells.

SUMMARY OF THE DISCLOSURE

In a first aspect, the present disclosure is directed to an isolated polynucleotide encoding a modified picornavirus 3C protease, wherein the modified picornavirus 3C protease includes one or more amino acid substitution(s) located at one or more amino acid position(s) corresponding to positions 16-25, 99-100 and 115-130 of a wild-type Fool-and-Mouth Disease Virus (FMDV) 3C protease. Typically, the wild-type FMDV 3C protease described herein is selected from among SEQ ID NOS: 2, 4, 6, 8, 10, 12, 14, 16, 18 and 20.

In some embodiments, the isolated polynucleotide encoding the modified picornavirus 3C protease, when transformed into and co-expressed in a host cell, enhances transgene expression of a P1 precursor polypeptide in comparison to an amount of P1 precursor polypeptide transgene expression exhibited in a host cell transformed and co-expressed with a control picornavirus 3C protease as herein defined.

In some embodiments, the modified picornavirus 3C protease encoded by the present isolated polynucleotide, such as a modified FMDV 3C protease as described herein, exhibits proteolytic activity on a picornavirus P1 precursor polypeptide.

In some embodiments, the modified picornavirus 3C protease encoded by the present isolated polynucleotide, such as a modified FMDV 3C protease as described herein, exhibits an increase or decrease in an amount of eIF4A1 proteolytically-cleaved in a host cell in comparison to an amount of eIF4A1 proteolytically cleaved in a host cell expressing a control picornavirus 3C protease. Typically, the modified picornavirus 3C protease exhibits a decrease in an amount of proteolytically-cleaved eIF4A1 in a host cell compared to an amount of proteolytically-cleaved eIF4A1 in a host cell expressing a control picornavirus 3C protease.

In some embodiments, the modified picornavirus 3C protease encoded by the present isolated polynucleotide, such as a modified FMDV 3C protease as described herein, exhibits an increase or decrease in an amount of histone H3, nuclear transcription factor kappa B essential modulator (NEMO), or Src-associated substrate in mitosis of 68 kDa (SAM68) in comparison to an amount of histone H3, NEMO, or SAM68 in a host cell expressing a control picornavirus 3C protease. Typically, the modified picornavirus 3C protease exhibits a decrease in an amount of histone H3, NEMO, or SAM68 in a host cell compared to an amount of histone H3, NEMO, or SAM68 in a host cell expressing a control picornavirus 3C protease.

In some embodiments, the isolated polynucleotide encoding the modified picornavirus 3C protease, expresses an altered protein secondary structure. For example, an altered alpha-helix, an altered beta sheet, an altered loop, etc. Typically, the altered secondary structure is selected from among an altered $A_1$-$B_1$ β sheet, an altered loop between an $F_1$ β strand and an $A_2$ β strand, and an altered $A_2$-$B_2$ β sheet, wherein the one or more amino acid substitution(s) is/are located at one or more positions selected from among at least one of: position(s) corresponding to one or more of amino acids 16-25 in the $A_1$-$B_1$ β sheet of a wild type Foot-and-Mouth Disease Virus (FMADV) 3C protease, position(s) corresponding to one or more of amino acids 99 and 100 in the loop between an $F_1$ β strand and an $A_2$ β strand of a wild type FMDV 3C protease, and position(s) corresponding to one or more of amino acids 115-130 in the $A_2$-$B_2$ β sheet of a wild type FMDV 3C protease.

In some embodiments, the one or more corresponding amino acid positions is/are identified by an alignment of a primary amino acid sequence of the modified picornavirus 3C protease with a primary amino acid sequence of the one or more of the wild type FMDV 3C proteases. Typically, the alignment is performed using Clone Manager 9, Professional Edition, Version 9.4, 1 Jan. 2015, using Blossum 62 with default parameters.

In some embodiments, the one or more corresponding amino acid positions is/are identified by comparing a protein conformation of the modified picornavirus 3C protease with a protein conformation of the one or more of the wild type FMDV 3C proteases as described herein. Typically, however, an alignment of the primary amino acid sequences is used to determine a corresponding amino acid position.

In some embodiments, the modified picornavirus 3C proteases of the present disclosure exclude modified FMDV 3C proteases. In other embodiments, the modified picornavirus 3C proteases exclude a modified FMDV 3C protease with one or more amino acid substitutions, wherein the one or more amino acid substitutions are selected from the group consisting of an amino acid substitution at position 125, an amino acid substitution at position 126, an amino acid substitution at position 127, an amino acid substitution at position 128, an amino acid substitution at position 129, an amino acid substitution at position 130 and combinations thereof.

In some embodiments, the modified picornavirus 3C protease may be obtained or derived from any species, subtype and/or serotype from any of the picornavirus genera including Aphthovirus, Aquamavirus, Avihepatovirus, Cardiovirus, Cosavirus, Dicipivirus, Enterovirus, Erbovirus, Hepatovirus, Kobuvirus Megrivirus, Parechovirus, Piscevirus, Salivirus, Sapelovirus, Senecavirus, Teschovirus and Tremovirus. Typically, the genera include Aphthovirus, Enterovirus and Hepatovirus.

Typical species within the Aphthovirus genus include Bovine rhinitis A virus, Bovine rhinitis B virus, Equine rhinitis A virus and Foot-and-mouth disease virus (FMDV). Typical Enterovirus species include Enterovirus A, Enterovirus B, Enterovirus C, Rhinovirus A and Rhinovirus B. Typical species within the Hepatovirus include Hepatitis A virus.

Typical desirable serotypes within FMDV include O, A, C, Southern African Territories (SAT) 1, SAT2, SAT 3 and Asia 1.

Typical desirable serotypes within Enterovirus A include coxsackievirus A10 and enterovirus A71.

Typical desirable serotypes within Enterovirus B include swine vesicular disease virus, coxsackievirus B1 and coxsackievirus B3, more typically coxsackievirus B1 and coxsackievirus B3.

Typical desirable serotypes within Enterovirus C include coxsackievirus A1, poliovirus 1, poliovirus 2 and poliovirus 3.

Typical desirable serotypes within Rhinovirus A include Human rhinovirus A2, Human rhinovirus A20 and Human rhinovirus A89.

Typical desirable serotypes within Rhinovirus B include Human rhinovirus B14.

In some embodiments, the modified picornavirus 3C protease is selected from among: a modified Aphthovirus 3C protease, such as a modified FMADV 3C protease, a modified Bovine rhinitis A virus 3C protease, a modified Bovine rhinitis B 3C protease, a modified Equine rhinitis 3C protease; a modified Enterovirus 3C protease, such as a modified Enterovirus A 3C protease, a modified Enterovirus B 3C protease, a modified Enterovirus C 3C protease, a modified Rhinovirus A 3C protease, a modified Rhinovirus B 3C protease; and a modified Hepatovirus 3C protease, such as a modified Hepatitis A virus 3C protease.

In some embodiments, the one or more amino acid substitutions comprise any amino acid substitution(s). Typically, the amino acid substitution(s) comprises a non-conservative substitution. More typically, the amino acid substitution is proline.

In some embodiments, the modified picornavirus 3C protease is selected from among a modified FMDI) 3C protease having one or more amino acid substitutions within residues 16-25, 99-100 and 115-130 or corresponding thereto, such as residues 16-25, 99-100 and 115-124, of a wild-type FMDV 3C protease; a modified Bovine rhinitis 3C protease having one or more amino acid substitutions within residues 16-25, 95, 96 and 111-124 of a wild type Bovine rhinitis A 3C protease or corresponding thereto; a modified Bovine rhinitis 3C protease having one or more amino acid substitutions within residues 16-25, 96, 97 and 112-125 of a wild type Bovine rhinitis B 3C protease or corresponding thereto; a modified Equine rhinitis A 3C protease having one or more amino acid substitutions within residues 16-25, 99-100 and 115-130 of a wild type Equine rhinitis A 3C protease or corresponding thereto; a modified Enterovirus A 3C protease having one or more amino acid substitutions within residues 19-24, 86, 87 and 100-113 of a wild type Human coxsackievirus A10 3C protease or corresponding thereto; a modified Enterovirus A 3C protease having one or more amino acid substitutions within residues 19-24, 86, 87 and 100-113 of a wild type Human enterovirus A71 3C protease or corresponding thereto; a modified Enterovirus B 3C protease having one or more amino acid substitutions within residues 18-23, 87, 88 and 102-112 of a wild type Human coxsackievirus B1 or B3 3C protease or corresponding thereto; a modified Enterovirus C 3C protease having one or more amino acid substitutions within residues 19-24, 86, 87 and 100-113 of a wild type Human coxsackievirus A1 3C protease or corresponding thereto, a modified Enterovirus C 3C protease within residues 18-23, 86, 87 and 100-113 of a wild type poliovirus 3C protease or corresponding thereto; a modified Rhinovirus 3C protease having one or more amino acid substitutions within residues 18-23, 86, 87 and 101-114 of a wild type Rhinovirus A or wild type Rhinovirus B or corresponding thereto; and a Hepatovirus 3C protease having one or more amino acid substitutions within residues 15-20, 99, 100 and 124-131 of a wild type Human hepatitis A 3C protease or corresponding thereto.

In some embodiments, the modified picornavirus 3C protease encoded by the isolated polynucleotide of the present disclosure may be a modified Aphihovirus 3C protease selected from among one or more of a modified FMDV 3C protease having one or more amino acid substitution(s) at one or more position(s) selected from among I22, L23, I99, L99, T100, D123, V124, G125, R126 and I128, such as selected from among I22 and L23, such as selected from among I99, L99 and T100, such as selected from among D123, V124, G125 and I128 of a wild type FMADV 3C protease; a modified Bovine rhinitis A virus 3C protease comprising one or more amino acid substitution(s) at one or more position(s) selected from among V22, C23, T96, L123 and F124, such as selected from among V22 and C23, or such as T96, or such as selected from among L123 and F124 of a wild type Bovine rhinitis A virus 3C protease; a modified Bovine rhinitis B 3C protease comprising one or more amino acid substitution(s) at one or more position(s) selected from among V22, R23, T97, V121 and L124, such as selected from among V22, R23, or such as T97, or such as selected from among V121 and L124 of a wild type Bovine rhinitis B 3C protease; and a modified Equine rhinitis A 3C protease comprising one or more amino acid substitution(s) at one or more position(s) selected from among Y22, C23, T100, A125 and T127, such as selected from among T22 and C23, or such as T100, or such as selected from among A125 and T127 of a wild type Equine rhinitis A 3C protease.

In some embodiments, the modified picornavirus 3C protease encoded by the isolated polynucleotide of the present disclosure is a modified Enterovirus 3C protease selected from among one or more of a modified Enterovirus A 3C protease, such as one or more of: a modified Human coxsackievirus A10 virus comprising one or more amino acid substitution(s) at one or more position(s) selected from among Q19, T20, T87, L102, I104, N105, M109 and M112, such as selected from among Q19 and T20, or such as T87, or such as selected from among L102, I104, N105, M109 and M112 of wild type Human coxsackievirus A10 virus 3C protease and a modified Human enterovirus A71 3C protease comprising one or more amino acid substitution(s) at one or more position(s) selected from among Q19, T20, T87, I104, N105, T106 and M109, such as selected from among Q19 and Q20, or such as T87, or such as selected from among I104, N105, T106 and M109 of a wild type Human enterovirus A71 3C protease; a modified Enterovirus B 3C protease, such as a modified Human coxsackievirus B1 3C protease comprising one or more amino acid substitution(s) at one or more position(s) selected from among K19, T20, R87, L102, I104, N105, T106, F109, M112 and I114, such as selected from among K19 and T20, or such as R87, or such as selected from among L102, I104, N105, T106, F109, M112 and I114 of a wild type Human coxsackievirus B1 and a modified Human coxsackievirus B3 3C protease comprising one or more amino acid substitution(s) at one or more position(s) selected from among K19, T20, R87, L102, I104, N105, T106, F109, M112 and I114, such as selected from among K19 and T20, or such as R87, or such as selected from among L102, I104, N105, T106, F109, M112 and I114 of a wild type Human coxsackievirus B3 3C protease: a modified Enterovirus C 3C protease selected from among one or more of a modified coxsackievirus A1 3C protease comprising one or more amino acid substitution(s) at one or more position(s) selected from among T19, T20, R87, L102, V104, N105, T106, F109 and M112, such as selected from among T19 and T20, or such as R87, or such as selected from among L102, V104, N105, T106, F109 and M112 of a wild type coxsackievirus A1 3C protease, and a modified Human poliovirus 3C protease comprising one or more amino acid substitution(s) at one or more position(s) selected from among T19, T20, R87, L102, I103, and V104, such as selected from among T19 and T20, or such as R87, or such as selected from among L102, I103, and V104 of a wild type Human poliovirus 3C protease; a modified Enterovirus 3C protease selected from among one or more of a modified Rhinovirus A 3C protease comprising one or more amino acid substitution(s) at one or more position(s) selected from among T19, T20, I86, R87, L102, L104, Q108, T112 and I114, such as selected from among T19 and T20, or such as selected from among I86 and R87, or such as selected from among L102, L104, Q108, T112 and I114 of a wild type RhinovirusA 3C protease and a modified Rhinovirus B 3C protease having one or more amino acid substitution(s) at one or more position(s) selected from among T19, T20, I86, R87, I112 and E114, such as selected from among T19 and T20, or such as selected from among I86 and I87, or such as selected from among I112 and E114 of a wild type Rhinovirus B 3C protease and a modified Hepatovirus, such as a modified Hepatitis A virus 3C protease having one or more amino acid substitutions at one or more position(s) selected from among G17, G18, G19, E20, T100, L119, T121, M128 and I130, such as selected from among G19 and E20, or such as T100, or such as selected from among T100, L119, T121, M128 and I130 of a wild type Hepatitis A virus 3C protease.

Typically, the wild-type FMDV 3C protease described herein is selected from among at least one of SEQ ID NOS: 2, 4, 6, 8, 10, 12, 14, 16, 18 and 20. Typically, the wild type Bovine rhinitis 3C protease described herein is selected from among SEQ ID NOS: 422 and 434. Typically, the wild type Equine rhinitis 3C protease described herein is SEQ ID NO: 444. Typically, the wild type Human coxsackievirus A10 3C protease described herein is SEQ ID NO: 478. Typically, the wild type Human coxsackievirus B1 3C protease described herein is SEQ ID NO: 494. Typically, the wild type Human coxsackievirus B3 3C protease described herein is SEQ ID NO: 510. Typically, the wild type Human coxsackievirus A1 3C protease described herein is SEQ ID NO: 462. Typically, the wild type Human enterovirus A71 3C protease described herein is SEQ ID NO: 536. Typically, the wild type Human hepatitis 3C protease described herein is SEQ ID NO: 538. Typically, the wild type Human poliovirus 3C protease described herein is selected from among SEQ ID NOS: 552, 566, and 580. Typically, the wild type Rhinovirus A 3C protease described herein is selected from among SEQ ID NOS: 604, 618 and 620. Typically, the wild type Rhinovirus B 3C protease described herein is SEQ ID NO: 594.

In some embodiments, the modified picornavirus 3C protease is a modified FMDV 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% to one or more of a wild-type FMDV 3C protease selected from among SEQ ID NOS: 2, 4, 6, 8, 10, 12, 14, 16, 18 and 20.

In some embodiments, the modified picornavirus 3C protease is a modified Bovine rhinitis 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to one or more of a wild type Bovine rhinitis 3C protease selected from among SEQ ID NOS: 422 and 434.

In some embodiments, the modified picornavirus 3C protease is a modified Equine rhinitis 3C protease encoded by the isolated polynucleotide of the present disclosure having at least 90%, such as at least 91%, such as at least 92%, such as at least 93%, such as at least 94%, such as at least 95° 0%, such as at least 96%, such as at least 97%, such as at least 98%, such as at least 99% identity to the wild type Equine rhinitis A 3C protease of SEQ ID NO: 444.

In some embodiments, the modified picornavirus 3C protease is a modified Enterovirus A 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human coxsackievirus A10 3C protease of SEQ ID NO: 478.

In some embodiments, the modified picornavirus 3C protease is a modified Enterovirus A 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human enterovirus A71 3C protease is SEQ ID NO: 536.

In some embodiments, the modified picornavirus 3C protease is a modified Enterovirus B 3 C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human coxsackievirus B1 3C protease of SEQ ID NO: 494.

In some embodiments, the modified picornavirus 3C protease is a modified Enterovirus B 3 C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human coxsackievirus B3 3C protease of SEQ ID NO: 510.

In some embodiments, the modified picornavirus 3C protease is a modified Enterovirus C 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human coxsackievirus A1 3C protease of SEQ ID NO: 462.

In some embodiments, the modified picornavirus 3C protease is a modified Enterovirus C 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to one or more of a wild type Human poliovirus 3C protease selected from among SEQ ID NOS:552, 566 and 580.

In some embodiments, the modified picornavirus 3C protease is a modified Enterovirus 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to one or more of a wild type Rhinovirus A 3C protease selected from among SEQ ID NOS: 604, 618 and 620.

In some embodiments, the modified picornavirus 3C protease is a modified Enterovirus 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Rhinovirus B 3C protease of SEQ ID NO:594.

In some embodiments, the modified picornavirus 3C protease is a modified Hepatitis A virus 3C protease encoded by the isolated polynucleotide of the present disclosure having at least 90%, such as at least 91%, such as at least 92%, such as at least 93%, such as at least 94%, such as at least 95%, such as at least 96%, such as at least 97%, such as at least 98%, such as at least 99% identity to the wild type Human hepatitis 3C protease of SEQ ID NO:538.

In some embodiments, the modified FMDV 3C protease encoded by the isolated polynucleotide of the present disclosure is selected from among SEQ ID NOS: 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 178, 180, 138, 140, 142, 144, 146, 148, 150, 152, 154, 156, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 302, 304, 306, 308, 310, 312, 314, 316, 318, 320, 322, 324, 326, 328, 330, 332, 334, 336, 338, 340, 342, 344, 346, 348, 350, 352, 354, 356, 358 and 360.

In some embodiments, the modified Bovine rhinovirus 3C protease encoded by the isolated polynucleotide of the present disclosure is selected from among SEQ ID NOS: 412, 414, 416, 418, 420, 424, 426, 428, 430 and 432.

In some embodiments, the modified Equine rhinovirus 3C protease encoded by the isolated polynucleotide of the present disclosure is selected from among SEQ ID NOS: 436, 438, 440, 442 and 446.

In some embodiments, the modified Enterovirus A 3C protease encoded by the isolated polynucleotide of the present disclosure is selected from among SEQ ID NO: 464, 466, 468, 470, 472, 474, 476, 512, 514, 516, 518, 520, 522 and 524.

In some embodiments, the modified Enterovirus A 3C protease encoded by the isolated polynucleotide of the present disclosure is selected from among SEQ ID NO: 480, 482, 484, 486, 488, 490, 492, 496, 498, 500, 502, 504, 506 and 508.

In some embodiments, the modified Enterovirus C 3C protease encoded by the isolated polynucleotide of the present disclosure is selected from among SEQ ID NO: 448, 450, 452, 454, 456, 458, 460, 540, 542, 544, 546, 548, 550, 554, 556, 558, 560, 562, 564, 568, 570, 572, 574, 576 and 578.

In some embodiments, the modified Rhinovirus A 3C protease encoded by the isolated polynucleotide of the present disclosure is selected from among SEQ ID NOS: 596, 598, 600, 602, 604, 606, 608, 610, 612, 614, 616, 618, 620, 622, 624, 626, 628, 630, 632 and 634.

In some embodiments, the modified Rhinovirus B 3C protease encoded by the isolated polynucleotide of the present disclosure is selected from among SEQ ID NO: 582, 584, 586, 588, 590 and 592.

In some embodiments, the modified Hepatitis A virus 3C protease encoded by the isolated polynucleotide of the present disclosure is selected from among SEQ ID NO: 528, 530, 532, 534, 536 652 and 654.

In some embodiments, the isolated polynucleotide encoding the modified picornavirus 3C protease as described herein further comprises at least one polynucleotide sequence encoding a picornavirus P1 precursor polypeptide. Typically, the picornavirus P1 precursor polypeptide is obtained from any of the picornavirus genera, species and/or strains as described herein.

In some embodiments, the isolated polynucleotide encoding the modified picornavirus 3C protease as described herein further comprises at least one polynucleotide sequence encoding a 3D peptide.

In some embodiments, the isolated polynucleotide encoding the modified picornavirus 3C protease as described herein encodes a fusion polypeptide, wherein the fusion polypeptide comprises at least polynucleotide sequence encoding a 3D peptide. Typically, the fusion polypeptide is a 3CD polypeptide.

In some embodiments, the picornavirus P1 precursor polypeptide is an FMDV P1 precursor polypeptide. In some embodiments, the FMDV P1 precursor polypeptide is selected from at least one of SEQ ID NOS: 363, 366, 369, 372, 375, 378, 381, 384 and 387. In some embodiments, the picornavirus P1 precursor polypeptide, such as an FMDV P1 precursor polypeptide, has a polynucleotide sequence at least 90% identical, such as at least 91% identical, such as at least 92% identical, such as at least 93% identical, such as at least 94% identical, such as at least 95% identical, such as at least 96% identical, such as at least 97% identical, such as at least 98% identical, such as at least 99% identical, such as 100% identical to SEQ ID NOS: 362, 365, 368, 371, 374, 377, 380, 383 and 386.

In another aspect, the present disclosure is directed to a modified picornavirus 3C protease encoded by the isolated polynucleotides of the first aspect of the present disclosure. In this subsequent aspect of the disclosure, the options and embodiments of the first aspect apply mutatis mutandis.

In another aspect, the present disclosure is directed to a vector comprising the isolated polynucleotide described above in the first aspect. In this subsequent aspect of the disclosure, the options and embodiments of the first aspect apply mutatis mutandis. Additional options and embodiments of the vector of the disclosure follow.

In some embodiments, the present vector comprising the isolated polynucleotide of the present disclosure is a minicircle vector as described herein, a plasmid vector, a baculovirus vector, an alphavirus vector, a lentivirus vector, a replication deficient adenovirus vector or a vaccinia virus vector.

In some embodiments, the vector of the present disclosure further comprises a polynucleotide encoding at least one protein or polypeptide of interest in addition to a polynucleotide encoding the modified picornavirus 3C protease as described herein. For example, the vector may further include at least one promoter or other transcription regulatory element, at least one prokaryotic or eukaryotic translation initiation sequence or other translation regulatory element, at least one translational interrupter sequence, and/or at least one reporter gene operatively linked to the polynucleotide sequence encoding the modified picornavirus 3C protease or to another protein of interest. Other proteins of interest include, for example, a picornavirus protein, such as at least one polynucleotide sequence encoding for VP0, VP3, VP1 and, optionally, 3D, 2A, Δ1D2A, GLuc and/or SGLuc.

In another aspect, the present disclosure is directed to a host cell comprising the vector described above. In this subsequent aspect of the disclosure, the options and embodiments of the first aspect and the aspect directed to the vector apply mutatis mutandis. Additional options and embodiments of the host cells of the present disclosure follow.

In some embodiments, the vectors described herein are expressed in the present host cells. The present host cells may be eukaryotic or prokaryotic host cells. Suitable eukaryotic cells that may be used with the vectors, polynucleotide constructs, compositions and/or methods as described herein include fungal cells such as *Saccharomyces cerevisiae, Pichia pastoris*; plant cells such as *Arabidopsis thaliana, Chlamydomonas reinhardtii, Glycine max, Nicotiana benthamiana, Nicotiana tabacum, Oryza* saliva and *Zea mays*; insect cells such as *Spodoptera frugiperda, Drosophila melanogaster*, Sf9, Sf21; vertebrate cells, such as mammalian cells, e.g., HEK-293 (human kidney embryo) cell, Chinese Hamster Ovary (CHO) cells, Baby Hamster Kidney (BHK) cells, LF-BK (porcine) cells and/or an LF-BK αV/β6 cell.

In some embodiments, the vector described herein is expressed in a host cell, such as an animal cell, such as vertebrate cell, such as a mammalian cell that is susceptible to picornavirus infection, e.g., an FMDV infection.

Suitable prokaryotic cells include gram-positive prokaryotic cells such as *Bacillus, Lactococcus, Streptomyces, Rhodococcus, Corynebacterium* and/or *Mycobacterium* and gram-negative prokaryotic cells such as *Escherichia* and *Pseudomonas*.

In another aspect, the present disclosure is directed to a composition including a polynucleotide or vector encoding the modified picornavirus 3C protease as described herein and a pharmaceutically acceptable excipient, adjuvant, buffer or solution suitable for proteolysis by the modified picornavirus 3C protease. In this subsequent aspect of the disclosure, the options and embodiments of the first aspect and the aspect directed to the vector apply mutatis mutandis.

In yet another aspect, the present disclosure is also directed to a method for processing a picornavirus P1 precursor polypeptide into picornavirus viral proteins and/or VLPs, which method comprises: culturing a host cell comprising the present isolated polynucleotides and/or a vector containing the present isolated polynucleotides in a suitable medium; and recovering at least one viral protein selected from among VP0, VP1, VP2, VP3 and VP4 and/or VLPs. In this subsequent aspect of the disclosure, the options and embodiments of the first aspect apply mutatis mutandis. The options and embodiments of the vector aspect and host cell aspect also apply mutatis mutandis. Additional options and embodiments of the present method follow.

In some embodiments, at least VP0, VP1 and VP3 are recovered. In some embodiments, the VLPs that are recovered are FMDV VLPs.

In some embodiments, the method for processing a picornavirus P1 precursor polypeptide into picornavirus viral proteins and/or VLPs, further comprises monitoring picornavirus 3C protease activity, such as a modified FMDV 3C protease or picornavirus P1 precursor polypeptide expression, such as FMDV P1 precursor polypeptide expression, by measuring an amount of secreted luciferase.

In some embodiments of the instant methods, at least 90%, such as at least 95%, of the picornavirus P1 precursor polypeptide, such as an FMDV P1 precursor polypeptide, which is expressed by a host cell of the present disclosure, is cleaved by a modified picornavirus 3C protease, such as a modified FMDV picornavirus 3C protease as described herein.

In some embodiments of the instant methods, less than 10%, such as less than 5%, such as less than 2% of one or more host cell proteins are cleaved by a picornavirus 3C protease, such as a modified FMDV 3C protease as described herein, in comparison to an otherwise identical host cell expressing a control picornavirus 3C protease.

In some embodiments of the instant methods, more picornavirus P1 precursor polypeptide as described herein, such as an FMDV P1 precursor polypeptide, is expressed or recovered from a host cell than is an amount from an otherwise identical host cell expressing a control picornavirus 3C protease.

In some embodiments of the instant methods, more VP0, VP1, VP2, VP3 VP4 and/or VLPs is (are) expressed and/or recovered from a host cell than is an amount from a control picornavirus 3C protease.

In some embodiments of the instant methods, a vector as described herein in a host cell as also described herein, encodes a modified picornavirus 3C protease, such as a modified FMDV 3C protease, a 2A or other translation interrupter sequence, and a picornavirus P1 precursor polypeptide, such as an FMDV P1 precursor polypeptide without an N-terminal methionine residue, and optionally at least one of GLuc, SGLuc or other luciferase, which can be secreted.

In some embodiments of the instant methods, a vector in a host cell as described herein encodes a modified picornavirus 3C protease, such as a modified FMDV 3C protease as described herein, a picornavirus 3D polymerase, a 2A or other translation interrupter sequence, and a picornavirus P1 precursor polypeptide, such as an FMDV P1 precursor polypeptide, within an N terminal methionine residue, and optionally at least one of GLuc, SGLuc or other luciferase, which can be secreted.

In some embodiments of the instant methods, a host cell of the instant disclosure comprises a vector expressing a fusion protein comprising a modified picornavirus 3C protease, such as modified FMDV 3C protease, as described herein, a picornavirus P1 precursor polypeptide, such as an FMDV P1 precursor polypeptide as described herein and at least one of GLuc, SGLuc or other luciferase, which can be secreted, and optionally at least one of a 3D, 2A, Δ1D2A, or other translation interrupter sequence.

In some embodiments of the instant methods, a host cell of the present disclosure comprises a vector expressing a fusion protein comprising a modified picornavirus 3C protease, such as modified FMDV 3C protease, as described herein, a picornavirus P1 precursor polypeptide, such as an FMDV P1 precursor polypeptide as described herein, a picornavirus 3D polymerase and at least one of GLuc, SGLuc or other luciferase, which can be secreted and, and optionally, at least one of a 2A, Δ1D2A, or other translation interrupter sequence.

The present disclosure is also directed to a method for inducing an immune response against a picornavirus comprising administering a vector or polynucleotide construct as described herein, which encodes a modified picornavirus 3C protease and a P1 precursor polypeptide, as herein described, to a subject in need thereof.

The present disclosure is also directed to a method for inducing an immune response against a picornavirus comprising administering VP0, VP1, VP2, VP3 and VP4 and/or VLPs as described herein, which is produced in a eukaryotic cell and/or a prokaryotic cell through the introduction of an isolated polynucleotide encoding the modified picornavirus 3C protease and a P1 precursor polypeptide, as described herein, to a subject in need thereof.

In these subsequent aspects of the disclosure, the options and embodiments of the first aspect apply mutatis mutandis.

BRIEF DESCRIPTIONS OF THE FIGURES

FIG. 1 also depicts processing the viral polyprotein into intermediate precursor polypeptides and ultimately into individual viral proteins.

FIG. 3 depicts the relative positions of exemplary known secondary structures and a triad of catalytic residues at positions 46, 84 and 163 in the amino acid sequence of the 3C protease of wild-type FMDV strain Asia Lebanon 89 (SEQ ID NO: 6).

FIG. 4 depicts an alignment of wild type 3C proteases from FMDV Asia Shamir (SEQ ID NO: 8), Bovine rhinitis A (SEQ ID NO: 412), Bovine rhinitis B (SEQ ID NO: 434), and Equine Rhinitis A (SEQ ID NO: 444) as described in the detailed description and Example 3. Selected secondary structures are also identified.

FIG. 5 depicts an alignment of wild type 3C proteases from FMDV (SEQ ID NO: 8), coxsackievirus A10 (SEQ ID NO: 478) and coxsackievirus A1 (SEQ ID NO: 462) as described in the detailed description and Example 3. Selected secondary structures are also identified.

FIG. 6 depicts an alignment of wild type 3C proteases from FMDV (SEQ ID NO: 8) and Human enterovirus A71 (SEQ ID NO: 526) as described in the detailed description and Example 3. Selected secondary structures are also identified.

Figure 8:
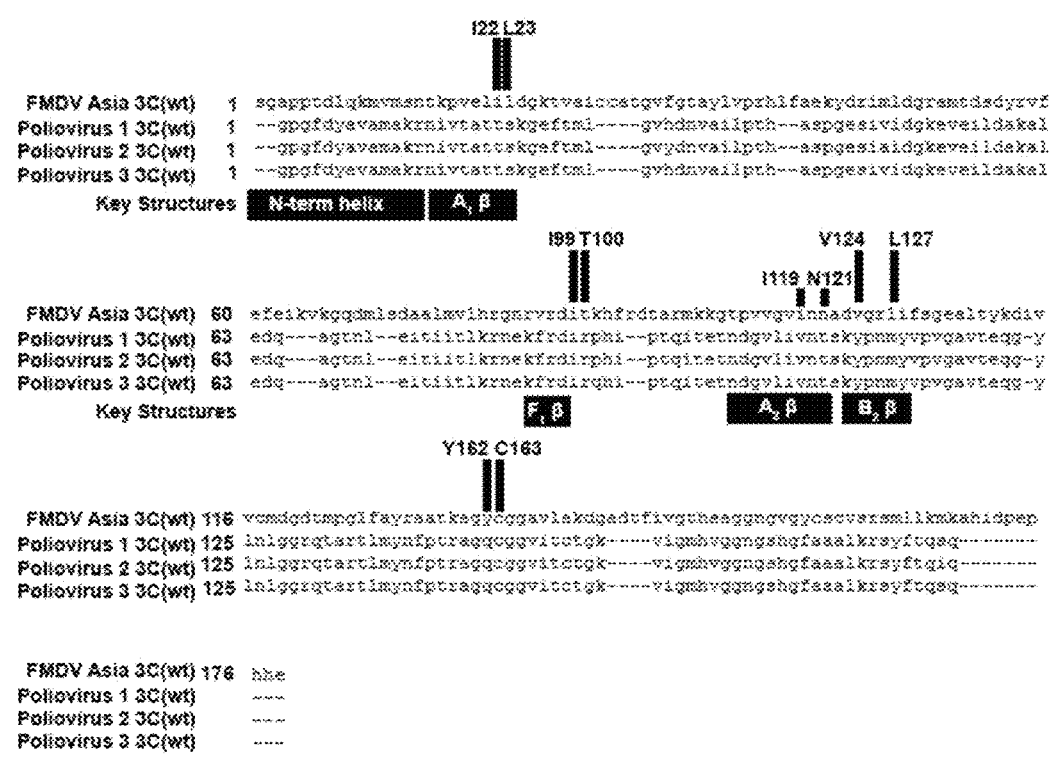

FIG. 8 depicts an alignment of wild type 3C proteases from FMDV (SEQ ID NO: 8), poliovirus 1 (SEQ ID NO: 580), poliovirus 2 (SEQ ID NO: 552) and poliovirus 3 (SEQ ID NO: 566) as described in the detailed description and Example 3. Selected secondary structures are also identified.

FIG. 9 depicts an alignment of wild type 3C proteases from FMDV (SEQ ID NO: 8), Human rhinovirus A2 (SEQ ID NO: 620), Human rhinovirus A89 (SEQ ID NO: 618) and Human rhinovirus A20 (SEQ ID NO: 604) as described in the detailed description and Example 3. Selected secondary structures are also identified.

FIG. 10 depicts an alignment of wild type 3C proteases from FMDV (SEQ ID NO: 8) and Human rhinovirus B14 (SEQ ID NO: 594) as described in the detailed description and Example 3. Selected secondary structures are also identified.

FIG. 11 depicts an alignment of wild type 3C proteases from FMDV (SEQ ID NO: 8) and Hepatitis A virus (SEQ ID NO: 538) as described in the detailed description and Example 3. Selected secondary structures are also identified.

FIG. 12 depicts an alignment of a portion of wild type 3C proteases from FMDV (SEQ ID NO: 8), Coxsackievirus A10 (SEQ ID NO: 478), coxsackievirus A1 (SEQ ID NO: 462), Poliovirus 1 (SEQ ID NO: 580), Poliovirus 2 (SEQ ID NO: 552), Poliovirus 3 (SEQ ID NO: 566), Human rhinovirus A2 (SEQ ID NO: 620), Human Rhinovirus A89 (SEQ ID NO: 618), Human rhinovirus A20 (SEQ ID NO: 604), Human rhinovirus B14 (SEQ ID NO: 594), Human enterovirus A71 (SEQ ID NO: 526), coxsackievirus B3 (SEQ ID NO: 510), coxsackievirus B1 (SEQ ID NO: 494), Hepatitis A virus (SEQ ID NO: 538), Bovine rhinitis A (SEQ ID NO: 412), Bovine rhinitis B (SEQ ID NO: 434) and Equine Rhinitis A (SEQ ID NO: 444) as described in the detailed description and Example 3. Selected secondary structures are also identified.

Figure 13A:
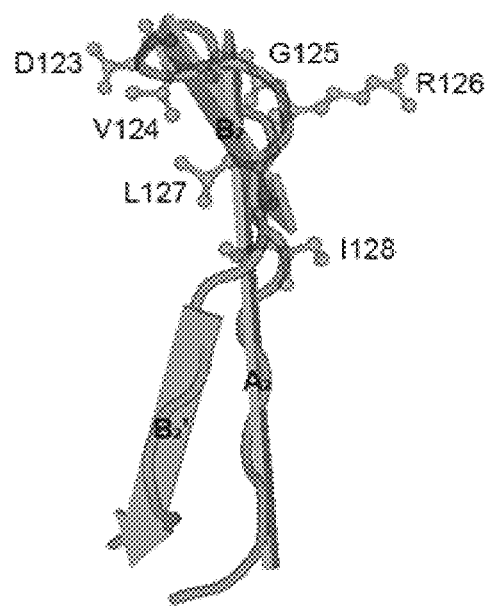
Figure 13B:
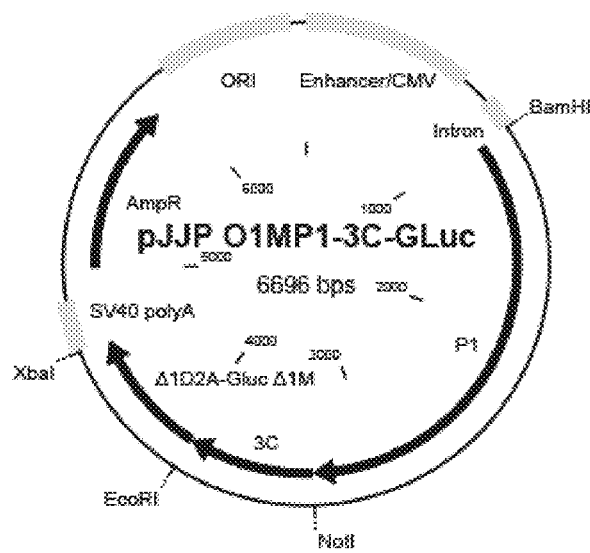
Figure 13C:
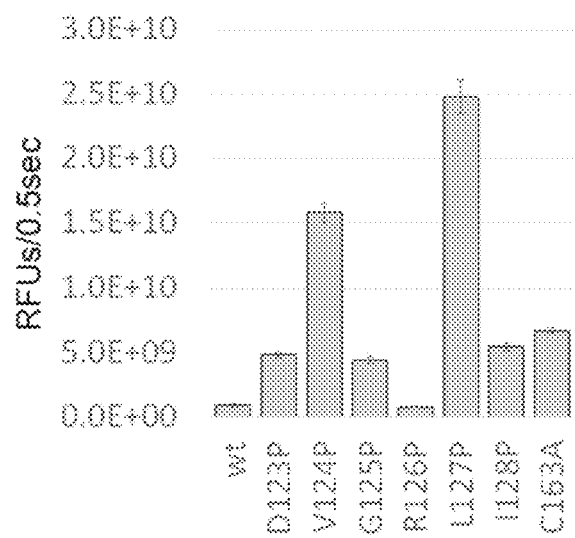
Figure 13D:
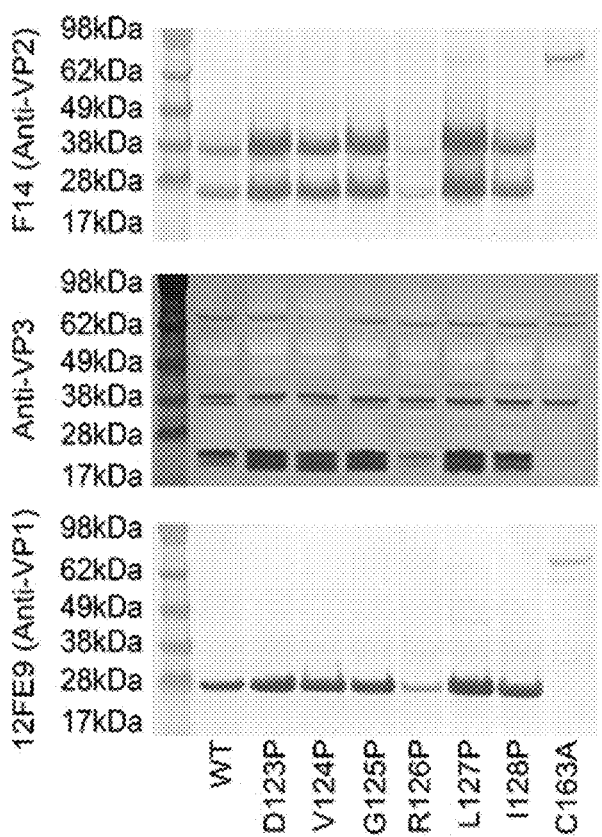

FIGS. 13A-13D. FIG. 13A depicts a portion of a crystal structure of an FMDV 3C protease (SEQ ID NO: 8) displaying side chains formed by amino acids 123 to 128 as described in Example 2A. FIG. 13B depicts a map of a pJJP expression plasmid encoding an FMDV P1 polypeptide (O1MP1) (SEQ ID NO: 374, a 3C protease and a marker (Δ1D2A-GLuc Δ1M) SEQ ID NO: 645 and SEQ ID NO: 648) as described in Examples 2A and 2B. FIG. 13C and FIG. 13D depict luciferase readings and a Western blot of cell lysates, respectively, obtained from HEK293T cells transfected with pJJP plasmids encoding for FMDV 3C protease mutants containing proline substitutions at residues 123 to 128 (SEQ ID NO: 389, SEQ ID NO: 403, SEQ ID NO: 390, SEQ ID NO: 399, SEQ ID NO: 397, SEQ ID NO: 391), a wild type FMDV 3C protease (SEQ ID NO: 405) and an FMDV 3C protease mutant containing alanine in place of cysteine at residue 163 SEQ ID NO: 388) as described in Examples 2A and 2B.

Figure 14:
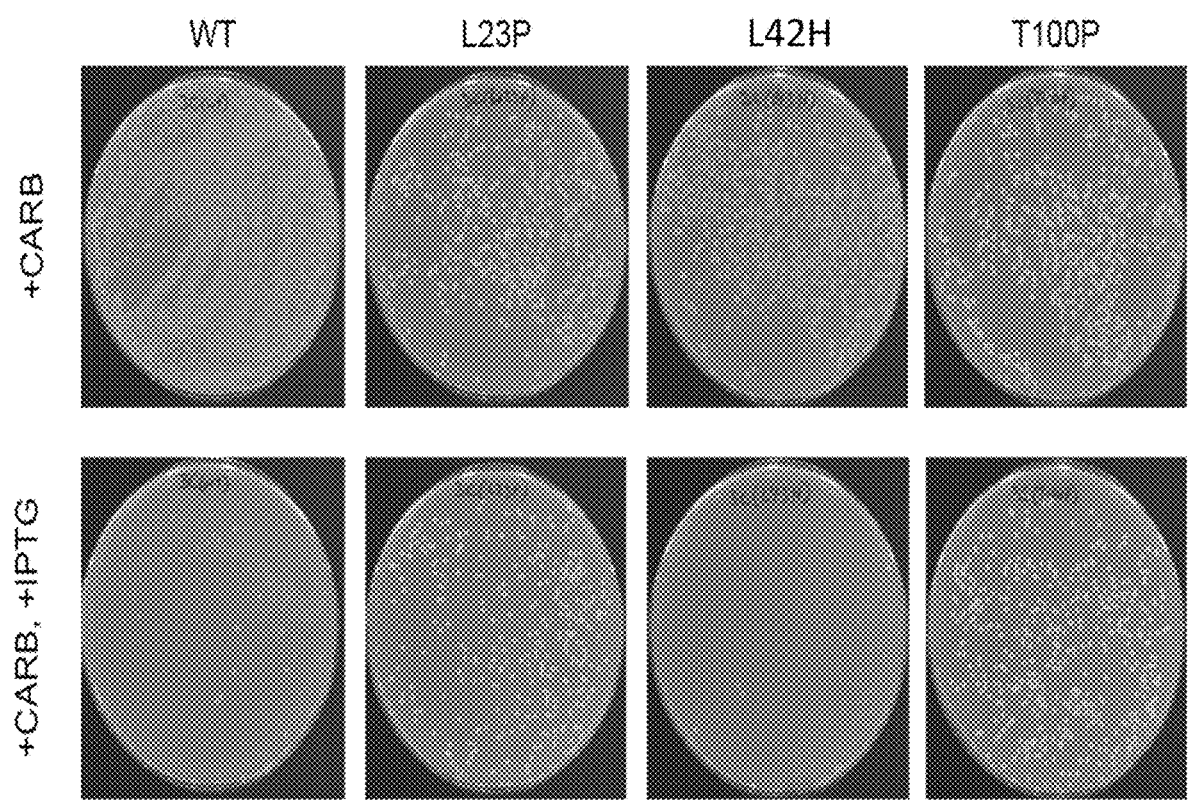

FIG. 14 depicts transformed E. coli bacteria on carbenicillin (+CARB) or carbenicillin/Isopropyl β-D-1-thiogalactopyranoside (+CARB/+IPTG) agar growth medium for evaluation of the effect of wild type 3C protease (SEQ ID NO: 8) expression and the 3C protease mutants, L23P (SEQ ID NO: 144), L42H (SEQ ID NO: 164) and T100P (SEQ ID NO: 208), on E. coli colony growth as described in Example 2B.

Figure 15A:
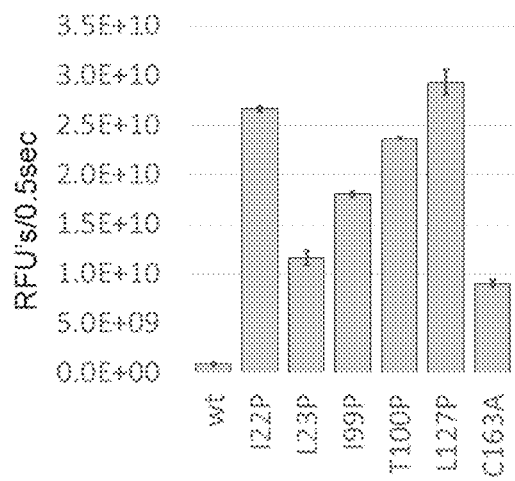
Figure 15B:
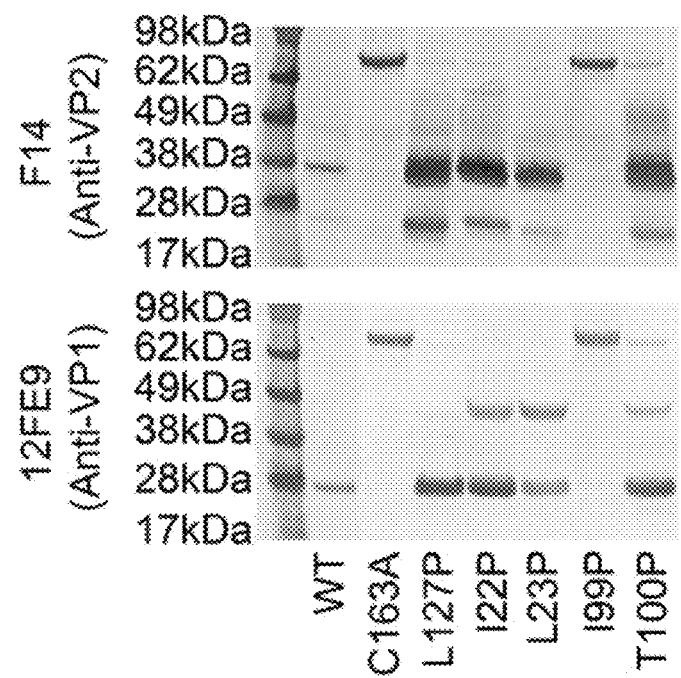

FIGS. 15A-15B: FIG. 15A and FIG. 15B depict luciferase readings and a Western blot of cell lysates, respectively, obtained from HEK293T cells transfected with pJJP plasmids encoding for FMDV3C protease mutants containing proline substitutions at residues I22 (SEQ ID NO: 392), L23 (SEQ ID NO: 398), I99 (SEQ ID NO: 396), T100 (SEQ ID NO: 400) and L127 (SEQ ID NO: 397), a wild type FMDV 3C protease (SEQ ID NO: 405) and an FMDV 3C protease mutant containing alanine in place of cysteine at residue 163 (SEQ ID NO: 388) as described in Example 2B.

Figure 16:
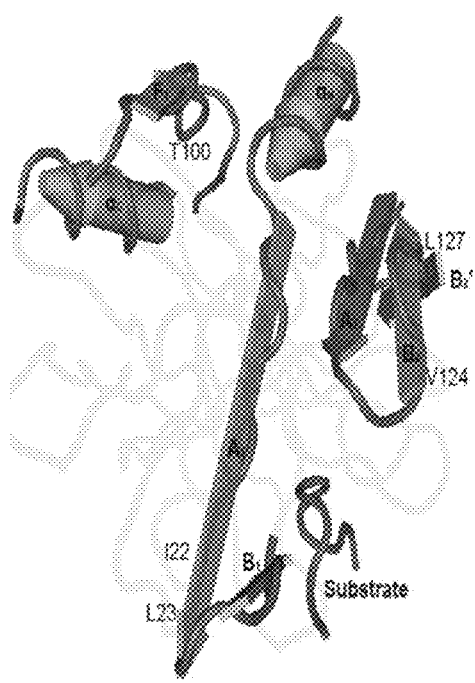

FIG. 16 depicts locations of residues T100 (SEQ ID NO: 208), V124 (SEQ ID NO: 228) and L127 (SEQ ID NO: 124) in a wild type FMDV 3C protease (SEQ ID NO: 8) and the relative locations of the structures containing these residues.

Figure 17A:
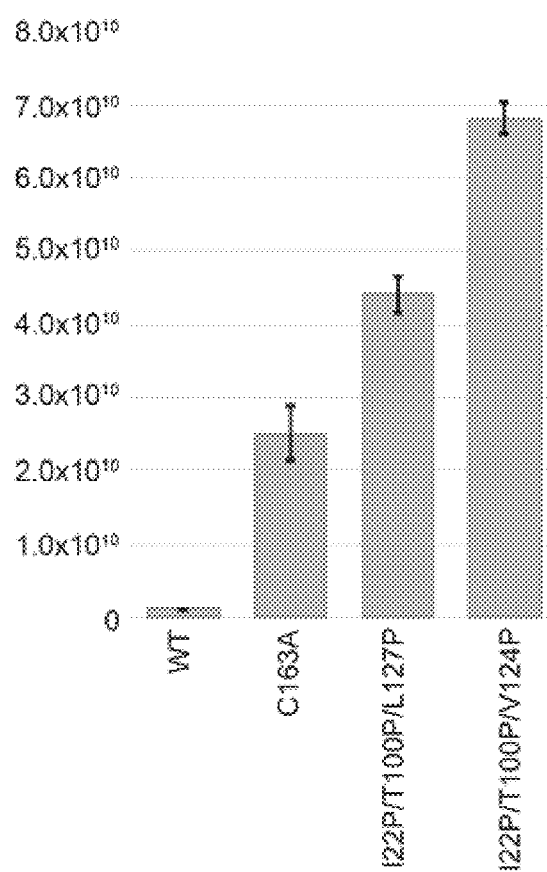
Figure 17B:
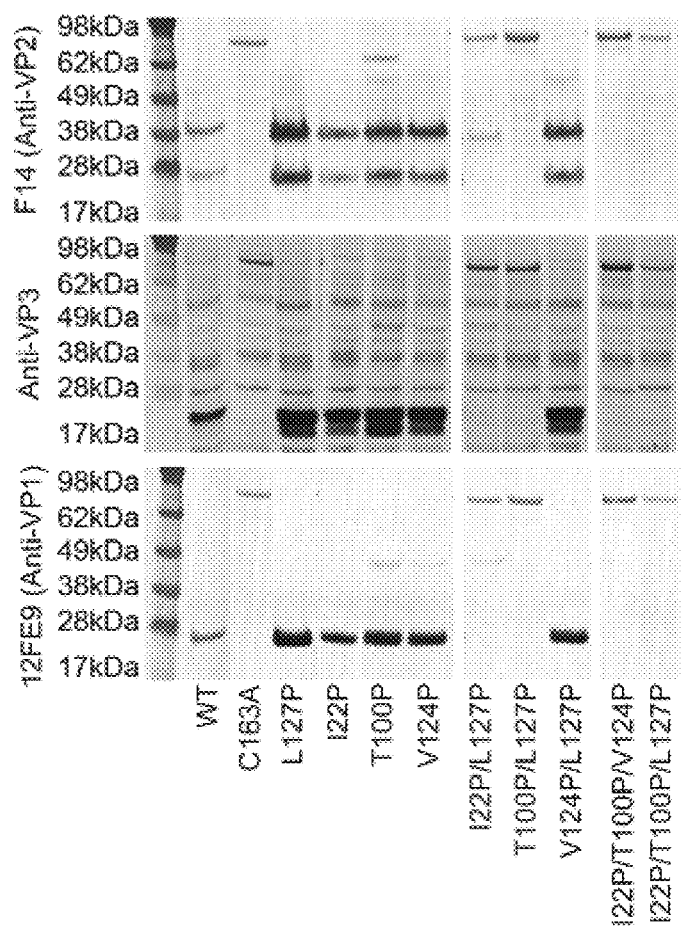

FIGS. 17A-17B: FIG. 17A and FIG. 17B depict luciferase readings and a Western blot of cell lysates, respectively, obtained from HEK293T cells transfected with pJJP plasmids encoding for FMDV 3C protease mutants containing proline substitutions at residues L127 (SEQ ID NO: 397), I22 (SEQ ID NO: 392), T100 (SEQ ID NO: 400) and V124 (SEQ ID NO: 403), FMDV 3C protease mutants containing double proline substitutions at residues I22 and L127 (SEQ ID NO: 393), residues T100 and L127 (SEQ ID NO: 401), and residues V124 and L127 (SEQ ID NO: 404), FMDV 3C protease mutants containing triple proline substitutions at residues I22, T100 and L127 (SEQ ID NO: 394) and residues I22, T100 and V124 (SEQ ID NO: 395), a wild type FMDV 3C protease (SEQ ID NO: 405) and an FMDV 3C protease mutant containing alanine in place of cysteine at residue 163 (SEQ ID NO: 388) as described in Example 2C.

Figure 18A:
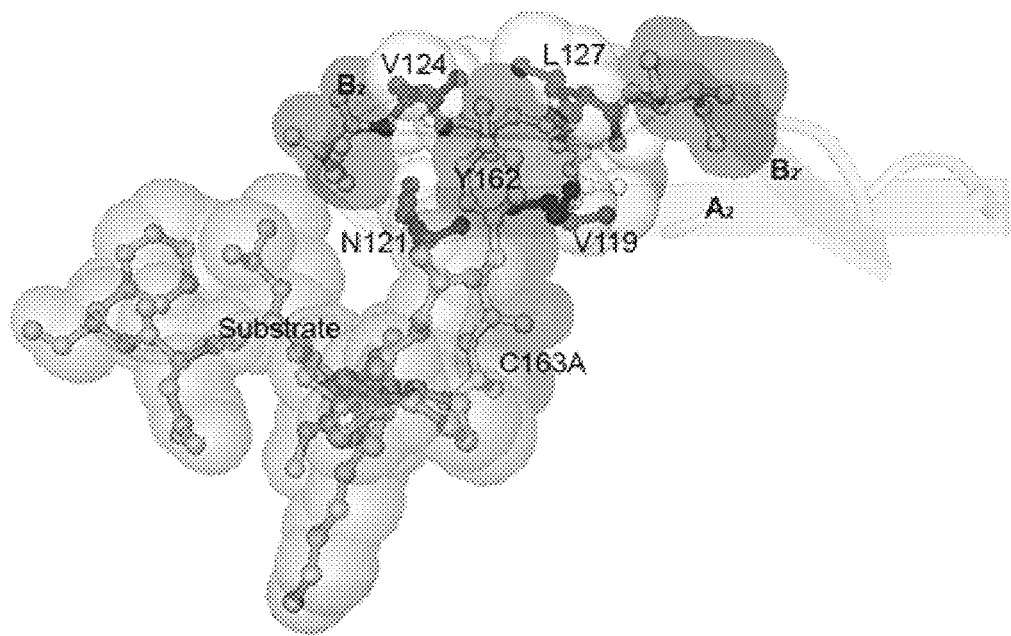
Figure 18B:
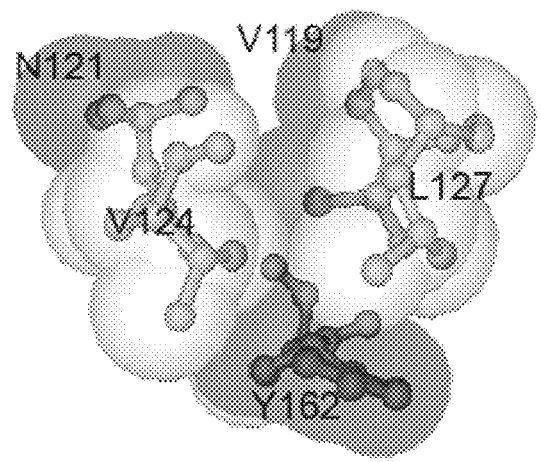
Figure 18C:
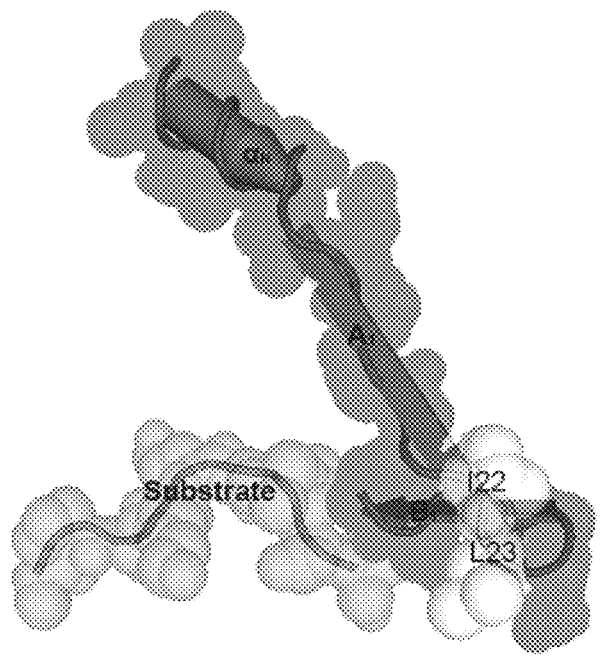
Figure 18D:
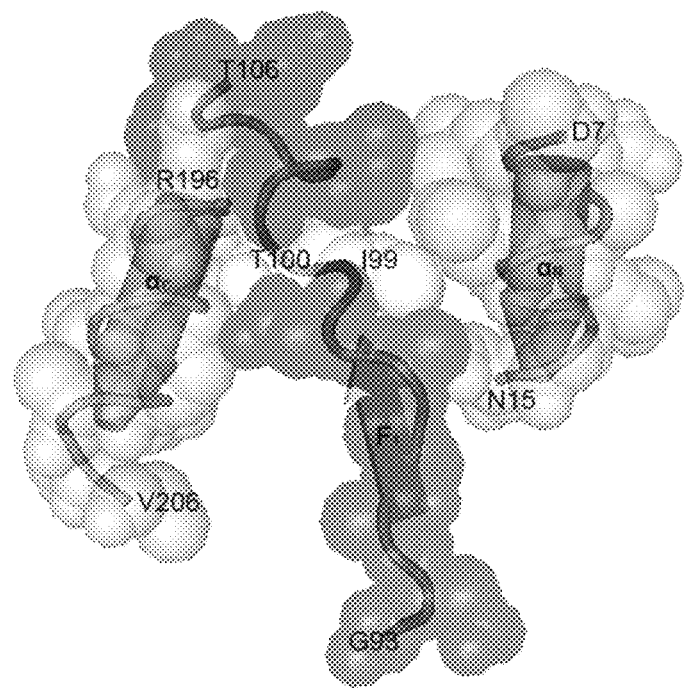

FIGS. 18A-18D: FIG. 18A depicts the structure of the $B_2$-$A_2$ β sheet in a wild type FMDV 3C protease (SEQ ID NO: 8) relative to the loop containing the C163 residue as described in Example 5D. FIG. 18B depicts the protease side chain structures for residues V119, N121, V124, and L127 relative to Y162 as also described in Example 2E. FIG. 18C depicts the structure spanning residues 7 to 28, which includes the N-terminal α helix and $A_1$ β strand, relative to the substrate binding pocket. Side chains of residues I22 and L23 are also shown. See Example 2E. FIG. 18D depicts structures connected to or proximal to residues I99 and T100 as also described in Example 2E.

Figure 19:
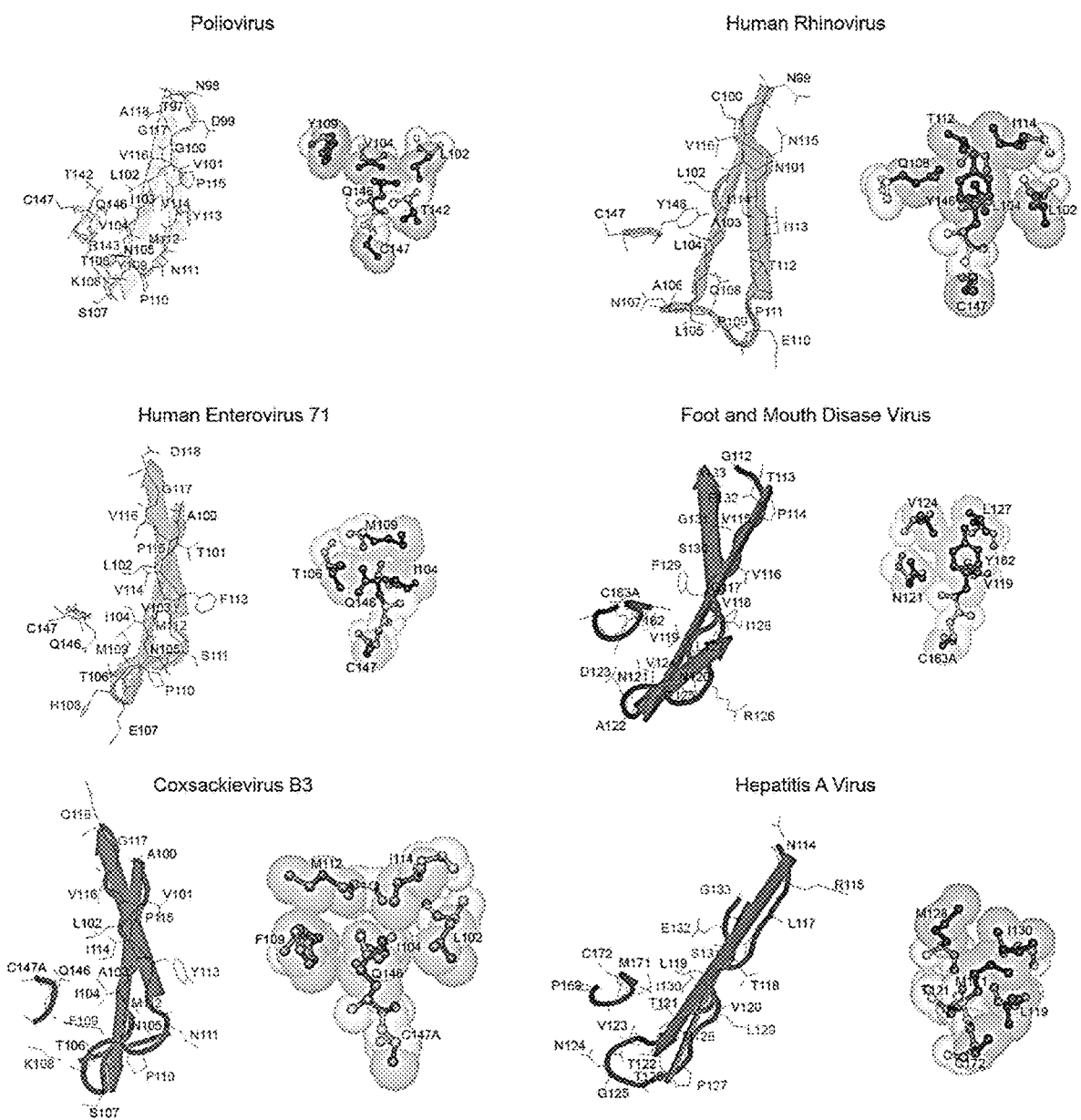

FIG. 19 depicts those residues with close side chain proximity to the residue adjacent the catalytic cysteine in crystal structures of 3C proteases from six picornaviruses as described in Example 2E.

Figure 20:
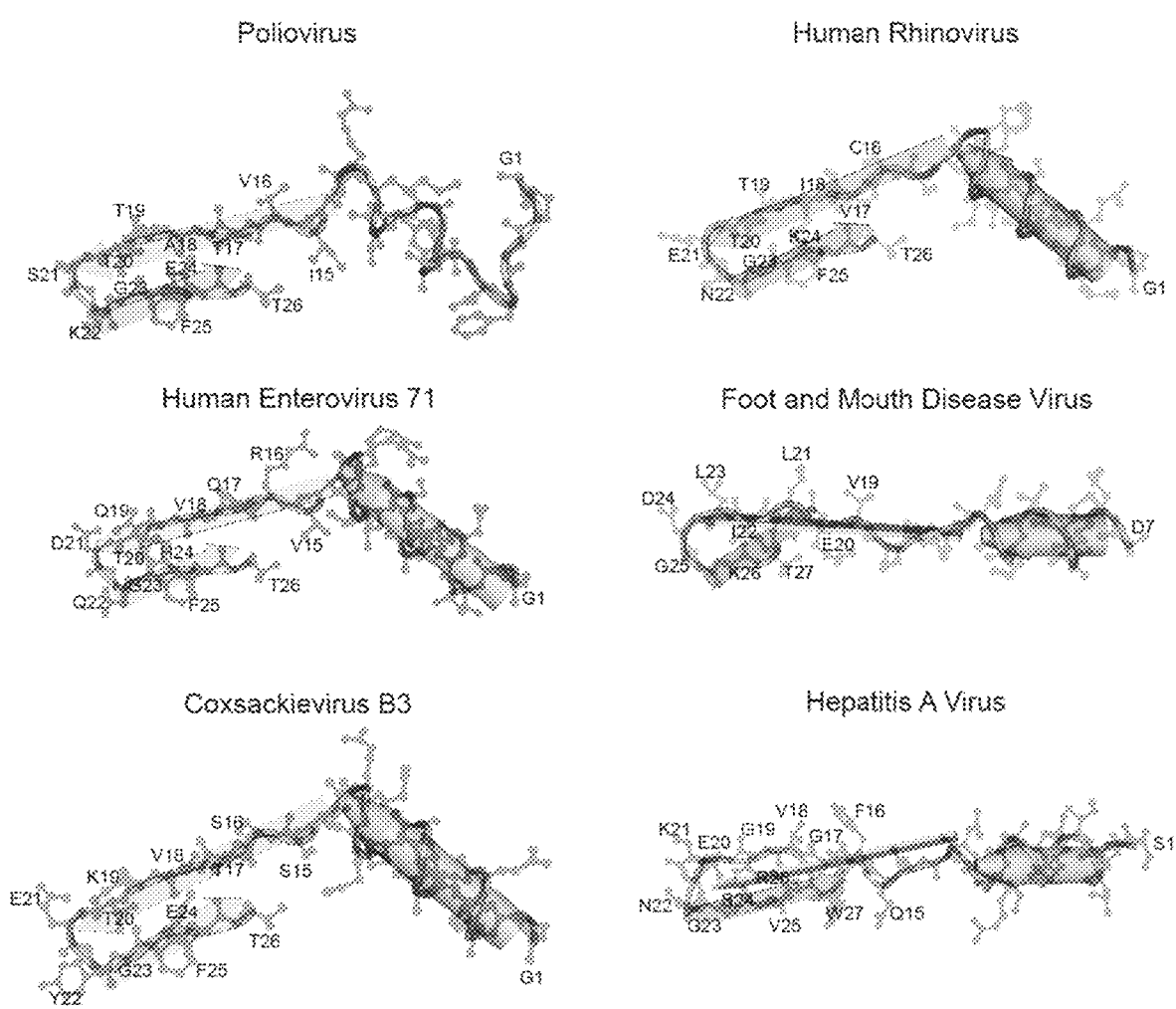

FIG. 20 depicts those residues in five picornavirus having structural homology to residues I22 and L23 of FMDV 3C protease as described in Example 2E.

Figure 21:
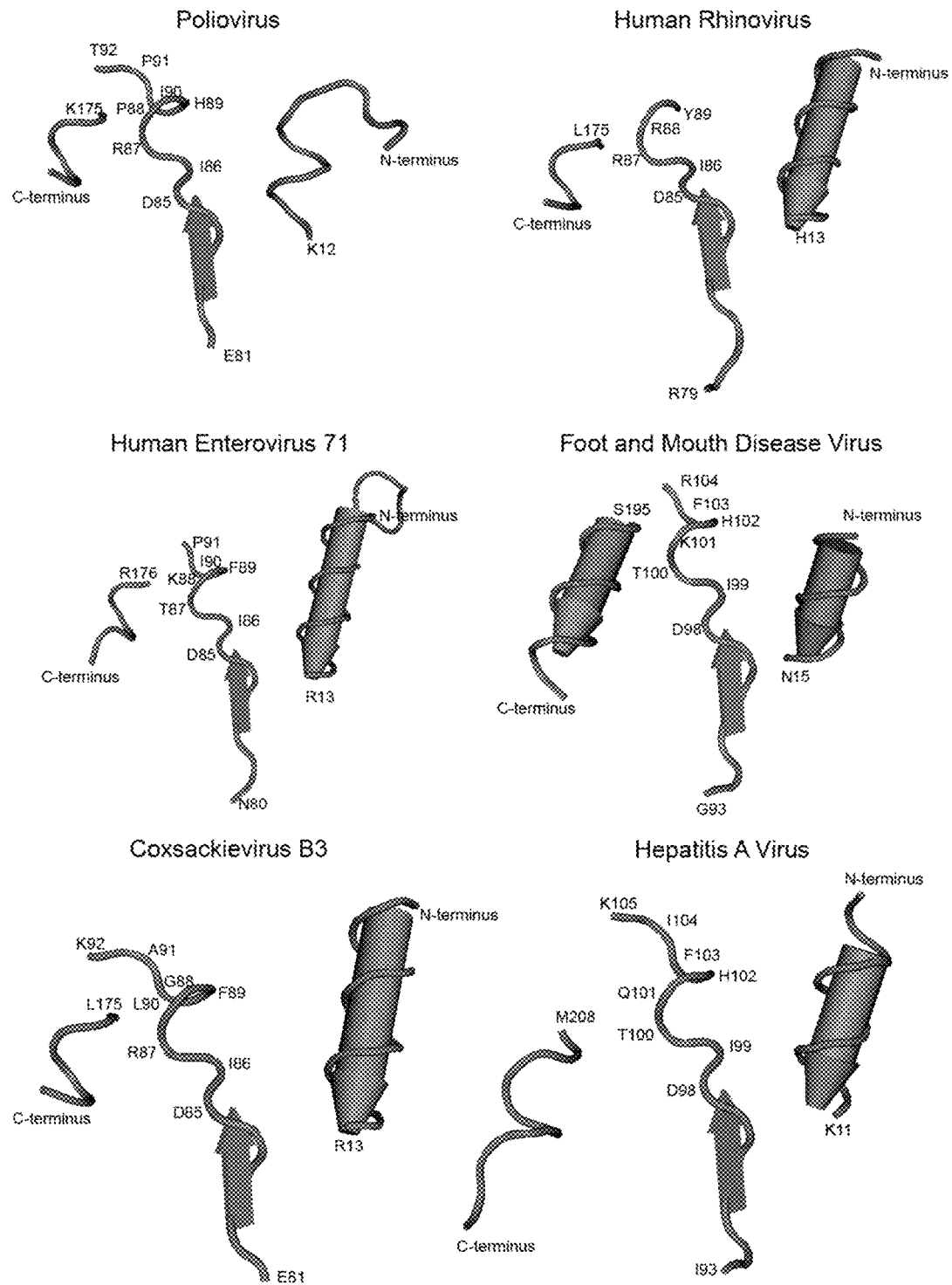

FIG. 21 depicts those residues in five picornavirus having structural homology to residue T100 of FMDV 3C protease as described in Example 2E.

Figure 22:
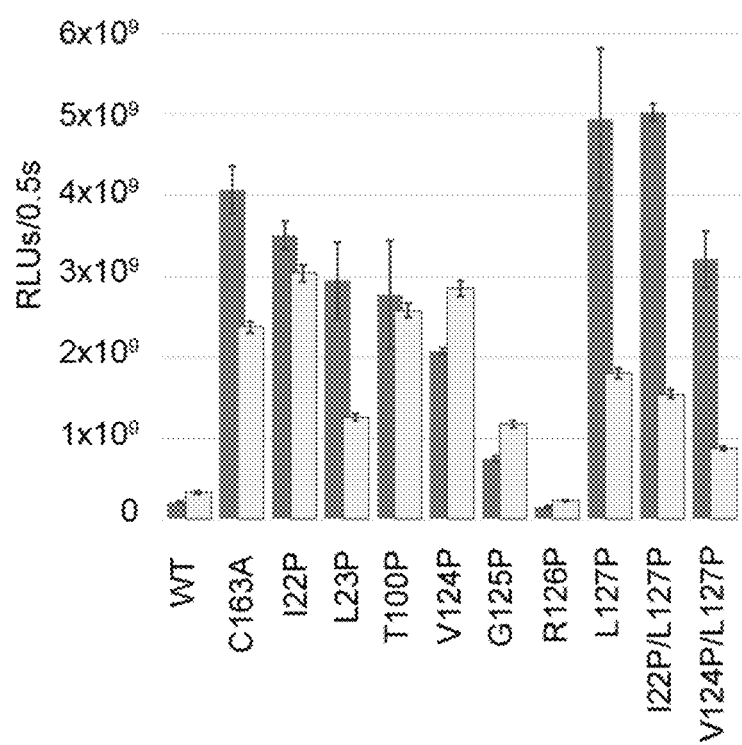

FIG. 22 depicts luciferase readings from CHO-K1 (dark gray) and BHK-21 (light gray) cells transfected with pJJP plasmids containing wild type FMDV 3C protease (SEQ ID NO: 405), FMDV 3Cpro proline mutations at residues I22 (SEQ ID NO: 392), L23 (SEQ ID NO: 398), T100 (SEQ ID NO: 400), V124 (SEQ ID NO: 403), G125 (SEQ ID NO: 390), R126 (SEQ ID NO: 399), L127 (SEQ ID NO: 397), and double mutant combinations I22/L127 (SEQ ID NO: 393) and V124/L127 (SEQ ID NO: 404) as described in Example 2D.

Figure 23A:
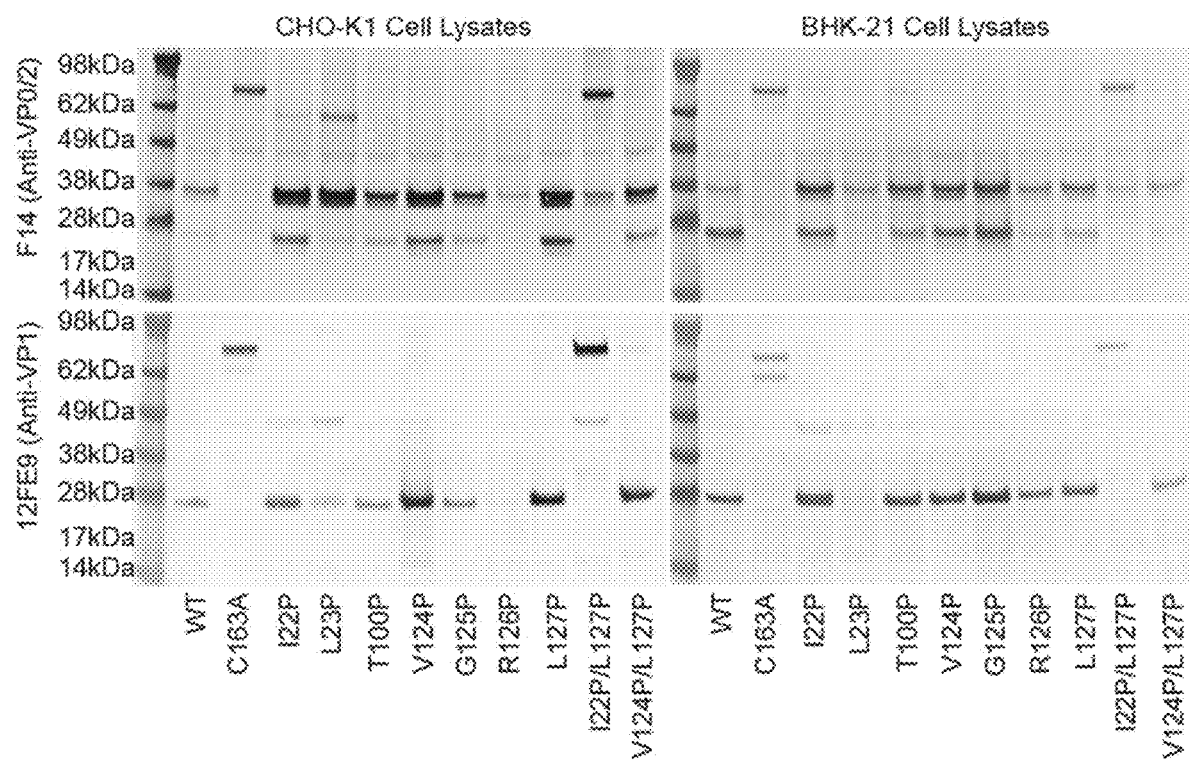
Figure 23B:
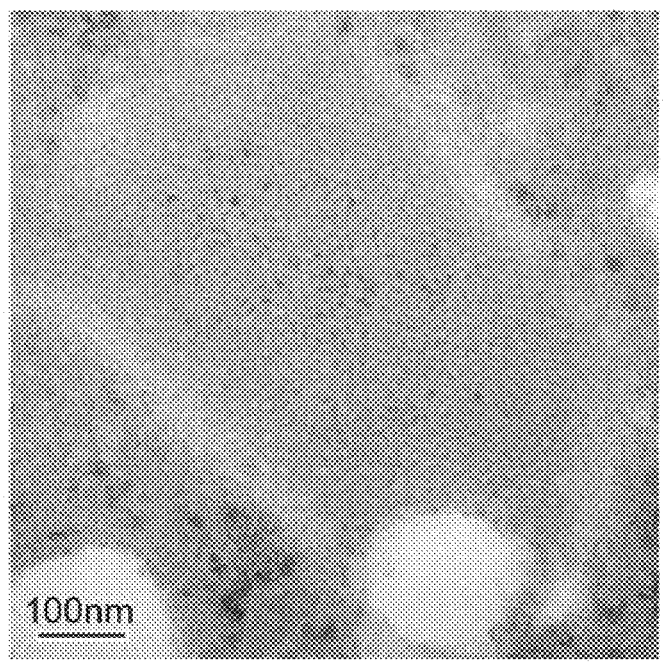
Figure 23C:
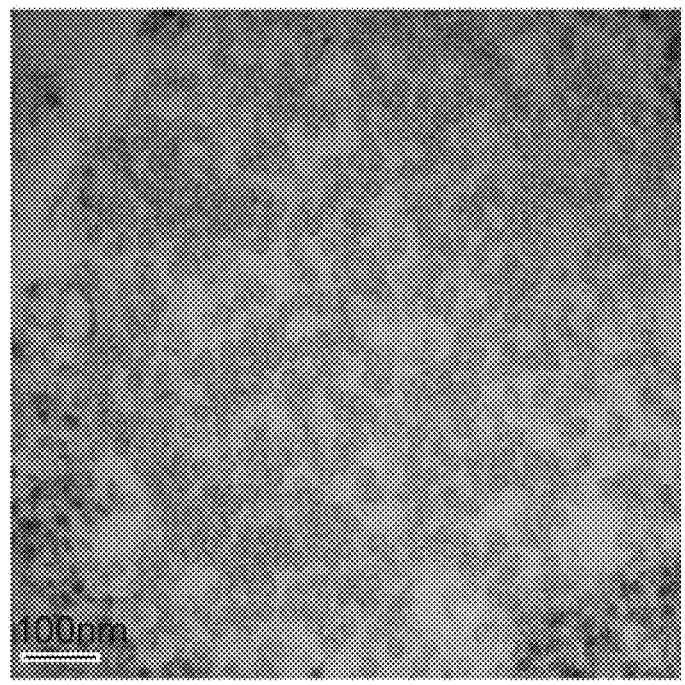

FIGS. 23A-23C: FIG. 23A depicts western blots of cell lysates from CHO-K1 and BHK-21 cells transfected with pJJP plasmids containing a wild type FMDV 3C protease (SEQ ID NO: 405), FMDV 3Cpro proline mutations at residues I22 (SEQ ID NO: 392), L23 (SEQ ID NO: 398), T100 (SEQ ID NO: 400), V124 (SEQ ID NO: 403), G125 (SEQ ID NO: 390), R126 (SEQ ID NO: 399), L127 (SEQ ID NO: 397), and double mutant combinations I22/L127 (SEQ ID NO: 393) and V124/L127 (SEQ ID NO: 404) as described in Example 2D. FIG. 23B depicts an electron microscopy image taken of VLP arrays in CHO-K1 cells transfected with a pJJP plasmid containing the L127P mutation and an O1 Manisa P1 polypeptide (SEQ ID NO: 397) as described in Example 2D. FIG. 23C depicts an electron microscopy image taken of VLP arrays in BHK-21 cells transfected with a pJJP plasmid containing the V124P mutation and an O1 Manisa P1 polypeptide (SEQ ID NO: 403) as described in Example 2D.

DETAILED DESCRIPTION

Definitions

As used herein, the term "isolated" refers to a polynucleotide, polypeptide or other component that is removed from at least one component with which it is naturally associated. For example, an isolated polynucleotide, polypeptide or other component may be present outside the cell in which it is typically found in nature, whether purified or not. Additionally or alternatively, the isolated component is found in a context other than that in which it is naturally found, e.g., separated from nucleotide sequences with which it typically is in proximity in nature, or adjacent (or contiguous with) nucleotide sequences with which it typically is not in proximity. Optionally, an isolated component, e.g., polynucleotide or polypeptide, may be subjected to one or more enrichment or purification procedures, e.g., cell lysis, extraction, centrifugation, precipitation, or the like.

A "nucleotide" refers to an organic molecule that serves as a monomer, or a subunit of nucleic acids like DNA and RNA. Nucleotides are building blocks of nucleic acids and are composed of a nitrogenous base (e.g., A (adenine), G (guanine), C (cytosine), T/U (thymine/uracil), a five-carbon sugar (ribose or deoxyribose), and at least one phosphate group. Thus, a nucleoside plus a phosphate group yields a nucleotide. Nucleotides in a polynucleotide sequence are commonly indicated based on their nitrogenous bases.

A "nucleotide sequence", "polynucleotide sequence" or a "nucleic acid sequence" is a succession of letters that indicate the order of nucleotides or nucleic acids within a DNA (using GACT) or an RNA molecule (using GACU). A DNA molecule, RNA molecule or other polynucleotide sequence may be single or double stranded and may be genomic, recombinant, synthetic, a transcript, a PCR product an amplification product, an mRNA or a cDNA. A "nucleotide sequence", "polynucleotide sequence" or a "nucleic acid sequence" may optionally comprise modified bases or a modified backbone. These terms are also meant to encompass a sequence in either a sense or an antisense orientation and the complement thereof.

A "recombinant polynucleotide" is a polynucleotide that is not in its native state, e.g., the polynucleotide comprises a nucleotide sequence not found in nature. For example, the sequence at issue can be cloned into a vector, or otherwise recombined with one or more additional nucleic acids.

As used herein, the term "picornavirus" refers to a non-enveloped virus representing a family of small, cytoplasmic, plus-strand RNA (~7.0-8.5 kb) viruses with an icosahedral capsid. Genera within this family include Aphthovirus, Aquamavirus, Avihepatovirus, Cardiovirus, Cosavirus, Dicipivirus, Enterovirus, Erbovirus, Hepatovirus, Kobuvirus Megrivirus, Parechovirus. Piscevirus, Salivirus, Sapelovirus, Senecavirus, Teschovirus and Tremovirus. The viral genome of a picornavirus generally contains one open reading frame that encodes a single polyprotein comprising a structural protein region, P1, and non-structural protein regions, P2 and P3. See FIG. 1. The release of mature and functional proteins from the polyprotein is primarily mediated by viral proteinases including 3C protease.

As used herein, the term "Aphthovirus" refers to a genus in the picornavirus family, which includes species such as Bovine rhinitis A virus, Bovine rhinitis B virus, Equine rhinitis A virus and FMDV.

As used herein, the term "Bovine rhinitis" refers to all Bovine rhinitis species including Bovine rhinitis A virus (BRAV) and Bovine rhinitis B virus (BRBV). This term is also meant to include Bovine rhinitis A virus serotypes including bovine rhinitis A virus 1 and bovine rhinitis A virus 2, which are also known as bovine rhinovirus 1 & 3, respectively.

As used herein, the term "Equine rhinitis" refers to any Equine rhinitis species including Equine rhinitis A virus (ERA V), also known as equine rhinovirus 1.

As used herein, the term "Enterovirus A" also known as "Human enterovirus A" refers to a species of the Enterovirus genus. The term "Enterovirus A" is meant to encompass serotypes of this species including coxsackievirus (CV) serotypes such as CV-A2, CV-A3, CV-A4, CV-A5, CV-A6, CV-A7, CV-A8, CV-A10, CV-A12, CV-A14 & CV-A16 and enterovirus (EV) serotypes such as EV-A71, EV-A76, EV-A89, EV-A90, EV-A91, EV-A92, EV-A114, and EV-A119. Simian Virus serotypes such as SV19, SV43, SV46 and Baboon serotypes, such as BA13 are also included in this species.

As used herein, the term "Enterovirus B" also known as "Human enterovirus B" refers to a species of the Enterovirus genus. The term "Enterovirus B" is meant to encompass serotypes of this species including coxsackievirus (CV) serotypes such as CVB1, CV-B2, CV-B3, CV-B4, CV-B5, CV-B6 and CV-A9 and enterovirus (EV) serotypes such as EV-B69, EV-B73, EV-B74, EV-B75, EV-B77, EV-B78, EV-B79, EV-B80, EV-B81, EV-B82, EV-B83, EV-B84, EV-B85, EV-B86, EV-B87, EV-B88, EV-B93, EV-B97, EV-B98, EV-B100, EV-B101, EV-B106, EV-B107, EV-B110 and SA5. Echovirus (E) serotypes such as E-1, E-2, E-3, E-4, E-5, E-6, E-7, E-9, E-11, E-12, E-13, E-14, E-15, E-16, E-17, E-18, E-19, E-20, E-21, E-24, E-25, E-26, E-27, E-29, E-30, E-31, E-32, & E-33 are also included in this species.

As used herein, the term "Enterovirus C" also known as "Human enterovirus C" refers to a species of the Enterovirus genus. The term "Enterovirus C" is meant to encompass serotypes of this species including coxsackievirus (CV) serotypes such as CV-A1, CV-A11, CV-A13, CV-A17, CV-A19, CV-A20, CV-A21, CV-A22 and CV-A24 and enterovirus (EV) serotypes such as EV-C95, EV-C96, EV-C99, EV-C102, EV-C104, EV-C105, EV-C109, EV-C116, EV-C117 and EV-C118. Poliovirus (PV) serotypes including PV1, PV2 and PV3 are also included in this species.

As used herein, the term "human coxsackievirus" is meant to encompass the coxsackievirus serotypes that infect humans. Such serotypes include Enterovirus A serotypes e.g., CV-A10, Enterovirus B serotypes e.g., CV-B1 and CV-B3; and Enterovirus C serotypes e.g. CV-A 1.

As used herein, the term "human poliovirus" is meant to encompass the poliovirus serotypes that infect humans. Such serotypes include Enterovirus C serotypes e.g., poliovirus-(PV-) 1, PV-2 and PV-3.

As used herein, the term "Rhinovirus A" also known as "Human rhinovirus A" refers to a species of the Enterovirus genus. The term "Rhinovirus A" encompasses human rhinovirus (HRV) serotypes such as HRV-A1, HRV-A2, HRV-A7, HRV-A8, HRV-A9, HRV-A10, HRV-A11, HRV-A12, HRV-A13, HRV-A15, HRV-A16, HRV-A18, HRV-A19, HRV-A20, HRV-A21, HRV-A22, HRV-A23, HRV-A24, HRV-A25, HRV-A28. HRV-A29, HRV-A30, HRV-A31, HRV-A32, HRV-A33, HRV-A34, HRV-A36, HRV-A38, HRV-A39, HRV-A40, HRV-A41, HRV-A43. HRV-A44, HRV-A45, HRV-A46, HRV-A47, HRV-A49, HRV-A50, HRV-A51, HRV-A53, HRV-A54, HRV-A55, HRV-A56, HRV-A57, HRV-A58, HRV-A59, HRV-A60, HRV-A61, HRV-A62, HRV-A63, HRV-A64, HRV-A65, HRV-A66, HRV-A67, HRV-A68, HRV-A71, HRV-A73, HRV-A74, HRV-A75, HRV-A76, HRV-A77, HRV-A78, HRV-A80, A81, HRV-A82, HRV-A85, HRV-A88, HRV-A89, HRV-A90, HRV-A94, HRV-A95, HRV-A96, HRV-A98, HRV-A100, HRV-A101, HRV-A102 and HRV-A103.

As used herein, the term "Rhinovirus B" also known as "Human rhinovirus B" refers to a species of the Enterovirus genus. The term "Rhinovirus B" encompasses human rhinovirus (HRV) serotypes such as HRV-B3, HRV-B4, HRV-B5, HRV-B6, HRV-B14, HRV-B17, HRV-B26, HRV-B27, HRV-B35, HRV-B37, HRV-B42, HRV-B48, HRV-B52, HRV-B69, HRV-B70, HRV-B72, HRV-B79, HRV-B83, HRV-B84, HRV-B86, HRV-B91, HRV-B92, HRV-B93, HRV-B97 and HRV-B99.

As used herein, the term "Hepatitis A virus" refers to a viral species belonging to the genus Hepatovirus and includes all serotypes within the Hepatitis A virus including hepatitis A virus 1.

As used herein, the terms "3C$^{pro}$", "3C protease", "picornavirus 3CP" or "picornavirus 3C protease" refer to a cysteine protease found in a picornavirus species, which typically contains a conserved Cysteine-Histidine-Aspartic Acid/Glutamic Acid catalytic triad or a Cysteine-Histidine dyad, (e.g., Hepatitis A virus) within its active site. The catalytic triad or dyad typically forms a charge-relay network that polarizes and activates the nucleophile (typically, cysteine) attacking the substrate to form a covalent intermediate, which is then hydrolyzed to regenerate free enzyme. 3C$^{pro}$ has been reported to conduct maturation cleavage in the structural and non-structural regions of the polyprotein and to have significant substrate preference in Glutamine-Glycine/Serine/Alanine/Valine/Histidine/Arginine and Glutamic Acid-Serine/Glycine/Arginine/Methionine.

As used herein, an "FMDV 3C protease" refers to a picornavirus 3C protease from the FMDV species. Generally, FMDV 3C proteases are cysteine proteases having a molecular weight of about 23.1-kDa and which contain 213 amino acids. The cysteine-histidine-aspartic acid catalytic triad at the active site of the FMDV 3C protease is formed by the residues H46, D84 and C163. Structurally, FMDV 3C proteases adopt a chymotrypsin-like fold that contains an N-terminus β-barrel domain and a C-terminus β-barrel domain (see FIG. 2). Each of the β-barrel domains is composed of a pair of four-stranded anti-parallel β-sheets that pack together to form a peptide or substrate binding cleft. The β-sheets are composed of $B_1$, A1, $D_1$, $E_1$ β-strands and $B_1$, $C_1$, $F_1$, $E_1$ β-strands (N-terminus domain) and $B_2$, $A_2$, $D_2$, $E_2$ β-strands and $B_2$, $C_2$, $F_2$, $E_2$ β-strands (C-terminus domain), where the B and E strands of each domain contribute to both β-sheets. Other secondary structures of the N-terminus and C-terminus β-barrel domains include loops or turns connecting the β-strands, e.g., $A_1$-$B_1$, $A_2$-$B_2$, $B_1$-$C_1$, $B_2$-$C_2$, $C_1$-$D_1$, $C_2$-$D_2$, $E_1$-$F_1$, $E_2$-$F_2$ loops. N-terminus α-helices ("$α_N$") and C-terminus α-helices ("$α_C$") are also secondary structures found within FMDV 3C proteases.

Figure 2:
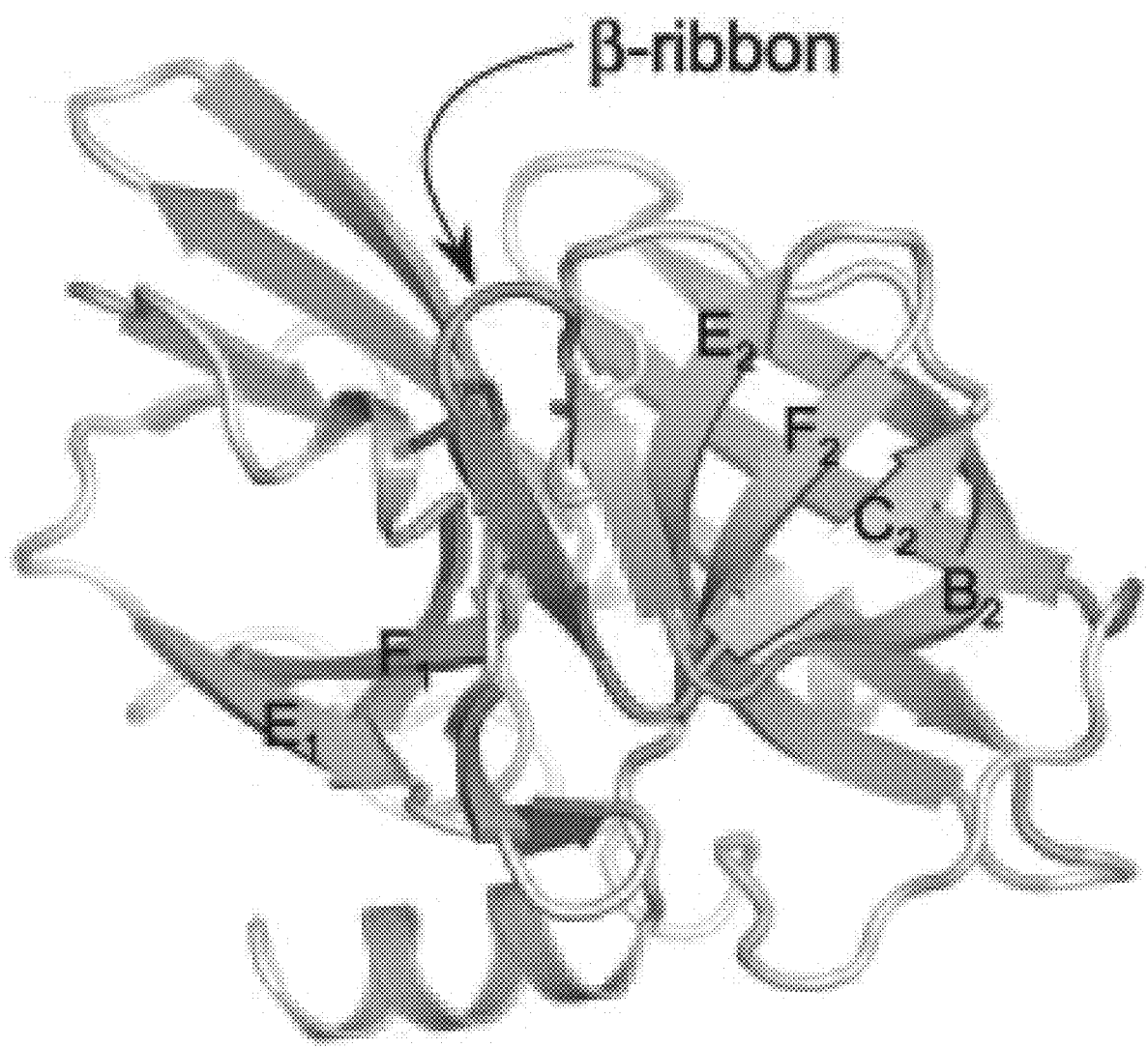
FIG. 2 depicts a diagram of an FMDV 3C protease (SEQ ID NO: 8) crystal structure as described in the detailed description.

In addition to the two β-barrel domains, the FMDV 3C protease possesses another prominent tertiary structure in the form of a β-strand having a small β-sheet of two short anti-parallel β-strands and an apical loop connecting the two β-strands. As seen in FIG. 2, the β-strand folds over the substrate binding cleft and active site and contributes to substrate recognition and specificity. The β-strand including the two β-strands and the apical loop is formed by residues 138 to 150 of the FMDV 3C protease, as indicated in FIG. 3.

As used herein, "primary structure" refers to the linear amino acid sequence of a protein, which chemically is a polypeptide chain composed of amino acids joined by peptide bonds.

As used herein, "secondary structure" refers to the three dimensional form of local segments of proteins. Secondary structure results from the interactions that occur between the carbon, oxygen and NH groups on amino acids in a polypeptide chain to form alpha-helices, beta-sheets, loops, β strands, and other forms that facilitate the folding of a peptide into a three dimensional structure. Particular examples of secondary structures include β sheets, such as $A_2$-$B_2$ β sheets, which are formed from a $B_2$ β strand and an $A_2$ β strand and $A_1$-$B_1$ β sheets which are formed from a $B_1$ β strand and an $A_1$ β strand. Other examples include the $B_2$' β strand, which may be present in Aphthovirus species such as FMDV. See e.g., FIG. 13A. See also FIG. 3, which aligns exemplary secondary structures of an FMDV 3C protease with their corresponding residues in the amino acid sequence.

As used herein, an "altered secondary structure" refers to a disrupted or changed protein secondary structure, such as an alpha-helix or beta-sheet, in comparison to that of a parent protein, such as a wild type protein. Altered secondary structure may be effectuated, e.g., by substituting a residue in a secondary structure with proline as described herein.

As used herein, the term "protein conformation" refers to the characteristic 3-dimensional shape of a protein, including the secondary (helices, sheet, strand), supersecondary (motifs), tertiary (domains) and quaternary (multimeric proteins) structure of a peptide chain. The term "native conformation" as used herein refers to the characteristic state, formation, shape or structure of a wild type protein in its biologically active form in a living system.

As used herein, the term "structural homology" refers to a three dimensional structure that is shared between two or more nucleic acids or polypeptides, and which may or may not be associated with a shared or conserved primary amino acid or nucleotide sequence.

As used herein, a "modified 3C protease", refers to a full-length 3C protease from a picornavirus species that is derived or obtained from a parent picornavirus 3C protease. As used herein "derived or obtained" refers to introducing into a parent amino acid sequence, or a polynucleotide encoding a parent amino acid sequence, at least one mutation e.g. a substitution, deletion or insertion of one or more amino acids or e.g. encoding for a substitution, deletion or insertion of one or more amino acids.

The term "parent" or "parent picornavirus 3C protease" as used herein refers to a picornavirus 3C protease to which a mutation is introduced in an encoding nucleotide sequence and/or polypeptide sequence to produce a modified picornavirus 3C protease of the present disclosure. The parent may be a wild type picornavirus 3C protease or a 3C protease that differs from wild type. That is, a parent 3C protease can be mutated, such that it differs from a wild type 3C protease, but is nonetheless referred to herein as a parent polypeptide relative to the subsequently modified polypeptide. Thus, existing 3C proteases known in the art that have been modified to have a desired increase or decrease in a particular activity, property or trait as compared to an unmodified reference protein, such as a wild type 3C protease, can be selected and used as a starting polypeptide, i.e., used as a parent polypeptide. For example, a 3C protease that has been modified from its native form by one or more single amino acid changes and possesses either an increase or decrease in a desired property, such as an increase or decrease in its ability to process P1 precursor polypeptide in comparison to an unmodified reference protein such as a wild type 3C protease, may be used as a parent and subjected to further modification to obtain a modified 3C protease of the present disclosure, which possesses the same or a different property.

The term "mutation" as used herein indicates any genetic modification of a nucleic acid and/or polypeptide resulting in an altered nucleic acid or an altered polypeptide. Mutations include, but are not limited to point mutations, deletions, and/or insertions of single or multiple nucleotides in a polynucleotide, which include alterations arising within a protein-encoding region of a gene as well as alterations in regions outside of a protein-encoding sequence, such as, but not limited to, regulatory or promoter sequences. Mutations may result in a silent, frame-shift or a nonsense mutation.

The terms "mutated", "mutant", "modified", "altered", "variant", and "engineered" are used interchangeably in the present application as adjectives describing a nucleotide sequence or a protein, such as a picornavirus 3C protease, that has been changed in reference to a parent 3C protease. As a non-limiting example, a "mutated nucleotide sequence encoding for a picornavirus 3C protease" refers to a nucleotide sequence encoding for a picornavirus 3C protease that is modified to be different from a parent, such as a wild-type, nucleotide sequence encoding for a picornavirus 3C protease. The mutated nucleotide sequence may or may not result in at least one of the following: one or more amino acid substitutions and a shift in the open reading frame for the translated peptide product, which folds properly (and may be functional or non-functional). In another non-limiting example, a "mutated picornavirus 3C protease", a "mutant picornavirus 3C protease", a "modified picornavirus 3C protease" or an "altered picornavirus 3C protease"

refers to a picornavirus 3C protease expressed from a mutated nucleotide sequence encoding for a picornavirus 3C protease, wherein the amino acid sequence has been changed, as compared to the wild-type picornavirus 3C protease, by e.g., one or more amino acid substitutions or a deletion of part of the protease (usually from the C-terminus), which may also lead to a change in one or more of the protein/protease properties, including but not limited to protein expression levels (e.g., transgene expression), substrate specificity, proteolytic activity towards picornavirus polypeptide precursors, proteolytic activity towards host proteins, thermal stability, solubility, etc.

A mutant, variant or modified polypeptide may have 75, 80, 85, 90, 95, 97.5, 98, 99, or 100% sequence identity or sequence similarity with a known picornaviral polynucleotide or polypeptide sequence, such as those described herein and in the sequence listing.

BLASTN may be used to identify a polynucleotide sequence having at least 75%, 80%, 85%, 87.5%, 90%, 92.5%, 95%0, 97.5%, 98%0, 99% sequence identity to a reference polynucleotide. A representative BLASTN setting optimized to find highly similar sequences uses an Expect Threshold of 10 and a Wordsize of 28, max matches in query range of 0, match/mismatch scores of 1/–2, and linear gap cost. Low complexity regions may be filtered or masked. Default settings of a Standard Nucleotide BLAST are described by and incorporated by reference to blast.ncbi.nlm.nih.gov/_Blast.cgi?PROGRAM=blastn&BLAST_PROGRAMS=megaBlast&PAGE_TYPE=BlastSearch&SHOW_DEFAULTS=on&LINK_LOC=blasthome (last accessed Feb. 4, 2016).

BLASTP can be used to identify an amino acid sequence having at least 75%, 80%, 85%, 87.5%, 90%, 92.5%, 95%, 97.5%, 98%, 99% sequence identity, or similarity to a reference amino acid using a similarity matrix such as BLOSUM45, BLOSUM62 or BLOSUM80 where BLOSUM45 can be used for closely related sequences, BLOSUM62 for midrange sequences, and BLOSUM80 for more distantly related sequences. Unless otherwise indicated a similarity score will be based on use of BLOSUM62. When BLASTP is used, the percent similarity is based on the BLASTP positives score and the percent sequence identity is based on the BLASTP identities score. BLASTP "Identities" shows the number and fraction of total residues in the high scoring sequence pairs which are identical; and BLASTP "Positives" shows the number and fraction of residues for which the alignment scores have positive values and which are similar to each other. Amino acid sequences having these degrees of identity or similarity or any intermediate degree of identity or similarity to the amino acid sequences disclosed herein are contemplated and encompassed by this disclosure. A representative BLASTP setting that uses an Expect Threshold of 10, a Word Size of 3, BLOSUM 62 as a matrix, and Gap Penalty of 11 (Existence) and 1 (Extension) and a conditional compositional score matrix adjustment. Other default settings for BLASTP are described by and incorporated by reference to the disclosure available at: blast.ncbi.nlm.nih.gov/_Blast.cgi?PROGRAM=blastp&PAGE_TYPE=BlastSearch&LINK_LOC=blasthome (last accessed Jun. 29, 2016).

The term "mutant", when used herein as a noun, depending on the context, or the term "variant" encompasses the following: a mutant nucleotide sequence encoding for a picornavirus 3C protease, a mutant picornavirus 3C protease, a transgene expression cassette containing a mutant nucleotide sequence encoding for a picornavirus 3C protease, and a vector carrying a mutant nucleotide sequence encoding for a picornavirus 3C protease. As a non-limiting example, a "C163A mutant", or a "3C(163A) mutant", depending on the context, refers to one of the following: a nucleotide sequence encoding for a picornavirus 3C protease, such as an FMDV 3C protease, wherein the cysteine residue at position 163 is substituted with an alanine, a picornavirus 3C protease, such as an FMDV 3C protease, wherein the cysteine residue at position 163 is substituted with an alanine, a transgene expression cassette containing a nucleotide sequence encoding for a picornavirus 3C protease, such as an FMDV 3C protease, wherein the cysteine residue at position 163 is substituted with an alanine, and a vector carrying a nucleotide sequence encoding for a picornavirus 3C protease, such as an FMDV 3C protease, wherein the cysteine residue at position 163 is substituted with an alanine.

As used herein, "substituted" and "substitutions" refer to the replacement of one or more amino acid residue(s) or nucleotide(s) at a particular position in a parent sequence (such as a wild type polypeptide sequence or a wild type polynucleotide sequence) with another amino acid or a codon encoding for an amino acid not present in the parent. For example, the substitution V124P refers to a modified polypeptide in which the valine at position 124 in a parent 3C protease is replaced with a proline.

The term "control picornavirus 3C protease" or "control 3C protease" as used herein refers to a picornavirus 3C protease having an activity, property, transcription level and/or translation level, which is compared to that of a modified picornavirus 3C protease of the present disclosure. A control picornavirus 3C protease has the same primary amino acid sequence as a modified picornavirus 3C protease except that it does not contain the one or more amino acid substitutions located at positions corresponding to positions 16-25, 99-100 and 115-130 of a wild-type FMDV 3C protease as described herein. In some embodiments, a control picornavirus 3C protease is a parent picornavirus 3C protease, such as a wild type 3C protease. In other embodiments, a control picornavirus does not contain the one or more amino acid substitutions located at positions corresponding to positions 20-25, 99-100 and 115-128 of a wild-type FMADV 3C protease, but contains other mutations. For example, a control 3C protease may have the same primary sequence as a wild type FMDV 3C protease, except for a mutation at the catalytic triad, for example C 163A.

The terms "wild-type", its acronym "wt", and the term "native" refer to a biological molecule that has not been genetically modified, for example, a nucleotide sequence encoding for a picornavirus 3C protease that exists in nature and has not been genetically modified, a picornavirus 3C protease translated from a coding nucleotide sequence that exists in nature and has not been genetically modified, a transgene expression cassette containing a nucleotide sequence encoding for a picornavirus 3C protease that exists in nature and has not been genetically modified, and a vector carrying a nucleotide sequence encoding for a picornavirus 3C protease that exists in nature and has not been genetically modified.

As used herein, "a P1 precursor", "a P1 precursor polypeptide" or "P1 precursor protein" is a polypeptide comprising structural proteins and/or precursors of the following structural proteins, VP0, VP1, VP2, VP3, and VP4, as well as the 2A translational interrupter. P1 precursors may be derived or obtained from any of the picornavirus genera, species, serotypes or strains described herein, e.g., a P1 precursor may be obtained or derived from wild type FMDV, which is around 85 kDa in molecular weight.

As used herein, the phrase "exhibits proteolytic activity on a picornavirus P1 polypeptide" refers to the processing of a P1 precursor polypeptide into structural proteins, e.g., VP0, VP1 and VP3 by a 3C protease. Typically, the structural proteins self-assemble into a non-enveloped icosahedral capsid and/or Virus-Like Particles "VLPs."

As used herein, "Virus-Like Particles" or "VLPs" refer to structures that are typically assembled into viral envelopes or viral capsids and, thus, resemble viruses, but are non-infectious since they lack viral genetic material. VLPs are typically capable of stimulating an immune response similar to a full virus.

As used herein, the term "VP0 protein" refers to a precursor peptide comprised of the VP2 and VP4 structural proteins. The VP0 protein is produced by the processing of the P1 precursor protein by a picornavirus 3C protease. In some embodiments, the VP0 protein along with VP3 and VP1 may be used in capsid and/or VLP assembly.

As used herein, "2A" refers to an FMDV translation interrupter sequence, see Luke, et al., Biotech. Genetic Eng. Revs. 26:223-260 (2009), which is herein incorporated by reference in its entirety. A 2A polynucleotide sequence is described by nucleotides 34-87 of SEQ ID NO: 645 and by the amino acid residues encoded thereby. Other 2A sequences may conform to the amino acid motif described by SEQ ID NO: 647. 2A interrupters from other Aphthoviruses may also be used.

As used herein, the term "A1D2A" refers to a translation termination sequence that typically comprises FMDV 1D residues and FMDV 2A amino acid residues. The polynucleotide sequence of SEQ ID NO: 645 encodes the Δ1D2A polypeptide of SEQ ID NO: 646. Other degenerate sequences encoding the polypeptide of SEQ ID NO: 646 may also be used. Polynucleotides 1-33 encode FMDV ID residues, 34-87 encode the 2A amino acid residues, and 88-90 encode a C-terminal proline residue as shown in SEQ ID NOS: 645 and 646. Other translation termination sequences similar to Δ1D2A may have fewer or more residues of the ID protein than A1D2A or may contain 1, 2, 3 or more point mutations to the 2A sequence that do not affect its ability to act as a translation termination sequence.

As used herein, "*Gaussia* luciferase" (GLuc) refers to a small, naturally secreted luciferase of 185 amino acids (SEQ ID NO: 649) and the nucleic acid encoding the secreted luciferase. The term is also meant to encompass proteins having at least 90%, such as at least 95% or such as at least 99% sequence identity with a native GLuc protein, for example, as set forth in SEQ ID NO: 649 and the nucleic acids encoding GLuc variants exhibiting luciferous properties. Typically, GLuc has a higher intensity than that of firefly or *Renilla* luciferases.

As used herein, "SGLuc" refers to a super luminescent GLuc variant (e.g., SEQ ID NO: 651) useful for examination of low levels of protein expression. SGLuc variants typically contain a mutation at amino acids 89 and 90 of a *Gaussia* luciferase gene (GLuc) gene, which expresses a secretory form of a GLuc luciferase and/or which expresses a GLuc luciferase that is capable of being secreted.

As used herein, a "vector" refers to any means by which a nucleic acid can be propagated and/or transferred between organisms, cells, or cellular components. Vectors include viruses, bacteriophage, pro-viruses, plasmids, phagemids, transposons, cosmids, viral vectors, expression vectors, gene transfer vectors, minicircle vectors, and artificial chromosomes such as YACs (yeast artificial chromosomes), BACs (bacterial artificial chromosomes), and PLACs (plant artificial chromosomes), and the like, that are "episomes," that is, that replicate autonomously or can integrate into a chromosome of a host cell. A vector typically contains at least an origin of replication, a cloning site and a selectable marker (e.g., antibiotic resistance). Natural versions of the foregoing non-limiting examples may be isolated, purified, and/or modified so the resultant natural version is differentiable from the material in its natural state. A vector can also be a naked RNA polynucleotide, a naked DNA polynucleotide, a polynucleotide composed of both DNA and RNA within the same strand, a polylysine-conjugated DNA or RNA, a peptide-conjugated DNA or RNA, a liposome-conjugated DNA, or the like, that are not episomal in nature, or it can be an organism which comprises one or more of the above polynucleotide constructs such as an *Agrobacterium* or a bacterium.

The term "recombinant vector" as used herein is defined as a vector produced by joining pieces of nucleic acids from different sources.

A "minicircle DNA vector", "minicircle vector" or "minicircle" is a small (usually in the range of 3-4 kb, or usually no larger than 10 kb) circular, episomal plasmid derivative wherein all prokaryotic vector parts (e.g., bacterial origin of replication, genes associated with bacterial propagation of plasmids) have been removed. Since minicircle vectors contain no prokaryotic DNA sequences, they are less likely to be perceived as foreign and destroyed when they are employed as vehicles for transferring transgenes into target mammalian cells.

A "transgene expression cassette", a "transgene expression construct", an "expression cassette", an "expression construct", a "construct", a "chimera", a "chimeric DNA", a "DNA chimera" or a "chimeric gene" is a nucleic acid sequence that has been artificially constructed to comprise one or more functional units (e.g. promoter, control element, consensus sequence, translational frameshift sequence, protein encoding gene etc.) not found together in nature, and is capable of directing the expression of any RNA transcript in an organism that the cassette has been transferred to, including gene encoding sequence(s) of interest as well as non-translated RNAs, such as shRNAs, microRNAs, siRNAs, and anti-sense RNAs. A transgene expression cassette may be single- or double-stranded and circular or linear. A transgene expression cassette can be constructed, inserted or cloned into a vector, which serves as a vehicle for transferring, replicating and/or expressing nucleic acid sequences in target cells.

As used herein, the term "transformation" refers to the process by which a vector or polynucleotide construct is introduced into a host cell. Transformation (or transduction, or transfection), can be achieved by any one of a number of means including chemical transformation (e.g. lithium acetate transformation), electroporation, microinjection, biolistics (or particle bombardment-mediated delivery), or *Agrobacterium* mediated transformation.

As used herein, "transfection" refers to the process by which a nucleic acid such as a gene cloned inside a vector (DNA or RNA) is delivered into a eukaryotic host cell.

As used herein, the term "host cell" refers to a prokaryotic (e.g. bacterial) or a eukaryotic cell (e.g. mammalian, insect, yeast etc.) that is naturally infected or artificially transfected or transformed with a virus or a vector, for example, by vaccination. The virus introduced to the host cell may be live, inactivated, attenuated or modified, while the vector introduced carries a transgene expression cassette that, when expressed in the host cell, may produce viral structural proteins that self-assemble to form virus-like particles (VLPs). In some cases, a host cell is inside of a host or subject and the host or subject is treated by administering a nucleic-acid-based vaccine encoding a modified picornavirus 3C protease of the instant disclosure, such as a modified FMDV 3C protease, and at least one other picornavirus antigen, such as an FMDV P1 precursor. In some embodiments, a modified picornavirus 3C protease-encoding polynucleotide is incorporated into a host cell genome via recombination, by use of a transposon, or by other recombinant DNA methods well known in the art. Picornavirus 3C proteases, such as an FMDV 3C proteases, and other picornavirus antigens, such as an FMDV P1 precursor, may be expressed from the same or different plasmids, episomes and/or other DNA or RNA constructs inside of a host cell.

A host cell for expression of a picornavirus 3C protease, a picornavirus P1 precursor protein, other proteins or antigenic sequences, as well as other proteins of interest may be a prokaryotic or eukaryotic cell. The term "host cell" includes yeast or fungal host cells, such as those of *Saccharomyces cerevisiae*, or *Pichia pastoris*; plant host cells, such as those of *Arabidopsis thaliana, Chlamydomonas reinhardtii, Glycine mar, Nicotiana benthamiana, Nicotiana tabacum, Oryza sativa*, or *Zea mays*: insect cells or insect cell lines such as those of *Spodoptera frugiperda, Drosophila melanogaster*. Sf9, or Sf21; the cells of vertebrates or mammals or mammalian cell lines, such as a HEK-293 (human kidney embryo) cell, CHO (Chinese hamster ovary) cell, BHK-21 (Syrian hamster kidney) cell, LF-BK (porcine cell), LF-BK αV/β6, or cells of animals susceptible to picornaviral infection; prokaryotic host cells such as those of gram-positive bacteria including cells of *Bacillus, Lactococcus, Streptomyces, Rhodococcus, Corynebacterium, Mycobacterium* or gram-negative bacteria such as *Escherichia* or *Pseudomonas*.

As used herein, the terms "residue" or "amino acid residue" refer to a specific amino acid within a polymeric chain of a peptide, a polypeptide or a protein. The terms encompass any of the twenty-two conventional proteinogenic amino acid residues (which include selenocysteine and pyrrolysine), a modified proteinogenic amino acid residue and/or a non-proteinogenic amino acid residue. Throughout the present disclosure, an amino acid residue may be represented by a three-letter code or a single-letter code, including but not limited to Ala (A) for alanine, Arg (R) for arginine, Asn (N) for asparagine, Asp (D) for aspartic acid, Cys (C) for cysteine, Gln (Q) for glutamine, Glu (E) for glutamic acid, Gly (G) for glycine, His (H) for histidine, Ile (I) for isoleucine, Leu (L) for leucine, Lys (K) for lysine, Met (M) for methionine, Phe (F) for phenylalanine, Pro (P) for proline, Ser (S) for serine, Thr (T) for threonine, Trp (W) for tryptophan, Tyr (Y) for tyrosine, Val (V) for valine, Pyl (O) for pyrrolysine, Sec (U) for selenocysteine.

The terms "amino acid sequence", "peptide sequence" or "protein sequence" refer to the order in which amino acid residues, connected by peptide bonds, arise in a peptide or protein chain. An amino acid sequence is generally reported from the N-terminal end containing a free amino group to the C-terminal end containing free carboxyl group. As used herein, a "non-coded amino acid", a "non-proteinogenic amino acid", a "synthetic amino acid" or an "unnatural amino acid" refers to an amino acid that is not naturally encoded or found in the genetic code (DNA or mRNA) of any organism, and has to therefore be synthesized in vitro.

A "genetically coded amino acid", a "coded amino acid" or a "natural amino acid" refers to an amino acid that is naturally encoded by or found in the genetic code (DNA or mRNA) of an organism, such as alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine, pyrrolysine and selenocysteine.

As used herein, the terms "prevent" and "preventing" include the prevention of the recurrence, spread or onset of a disease, disorder, condition and/or infection, such as a picornaviral infection. It is not intended that the present disclosure be limited to complete prevention. In some embodiments, prevention delays disease onset, reduces severity, reduces contagion, or otherwise alters disease symptoms and presentation.

As used herein, the terms "treat" and "treating" encompass a delay in disease progression, a decrease of particular symptoms, a reduction of contagion, or otherwise affects disease presentation, symptoms or progression. Prevention or treatment with a vaccine according to the present disclosure may involve the induction of cellular (e.g., via T-cells) or humoral (e.g., via antibodies) immunity. Such a vaccine will usually contain one or more picornavirus antigens, such as one or more FMDV antigens, produced by a host cell expressing a modified picornavirus 3C protease, such as a modified FMDV 3C protease. However, DNA-based vaccines that express modified picornavirus 3C protease, such as a modified FMDV 3C protease and other picornavirus antigens, such as other FMDV antigen(s) are also contemplated.

The term "in vivo" when referencing a reaction, such as the production of picornavirus VLPs, gene expression (e.g., of an FMDV polypeptide precursor, a wild-type or modified FMDV 3C protease, etc.), DNA transcription, mRNA translation, cleaving of a picornaviral, such as an FMDV, polypeptide precursor (e.g. P1, etc.), means that the reaction takes place within the environment of a living cell, such as a viral host cell. The living cell may be a living cell inside a host or other organism or in an artificial culture medium.

As used herein, the term "in vitro" in reference to a reaction, such as the production of VLPs, gene expression (e.g. expression of an FMDV polypeptide precursor, a wild-type or modified FMDV 3C protease, etc.), DNA transcription, mRNA translation, cleaving of a picornaviral, such as an FMDV, polypeptide precursor (e.g. P1, etc.), means that the reaction takes place in any environment with the exception of a living cell, including a solution, a liquid/solid culture medium in a test tube, a flask, a petri dish, etc.

DETAILED DESCRIPTION

Polynucleotides and Polypeptides with Modifications at Locations Corresponding to Amino Acid Positions in FMDV 3C Proteases FMDV Corresponding Positions One aspect of the present disclosure is directed to an isolated polynucleotide encoding a modified picornavirus 3C protease. In some embodiments, the modified picornavirus 3C protease encoded by the isolated polynucleotide includes one or more amino acid substitutions located at position(s) corresponding to amino acid position(s) 16-25, 99-100 and 115-130 of a wild-type FMDV 3C protease, such as the wild-type FMDV 3C protease sequences set forth as amino acid SEQ ID NOS: 2, 4, 6, 10, 12, 14, 16, 18 and 20. Modified 3C proteases encoded by such isolated polynucleotides are also contemplated.

Other Picornaviral Corresponding Positions

In some aspects, the present disclosure is also directed to an isolated polynucleotide encoding a modified picornavirus 3C protease, wherein the modified picornavirus 3C protease is selected from among, for example, a modified Bovine rhinitis 3C protease including one or more amino acid substitutions located at a position corresponding to one or more of amino acid positions 22, 23, 96, 97, 121, 123 and 124 of a wild type Bovine rhinitis 3C protease; a modified Equine rhinitis 3C protease including one or more amino acid substitutions located at a position corresponding to one or more of amino acid positions 23, 100, 125 and 127 of a wild type Equine rhinitis 3C protease; a modified Human coxsackievirus 3C protease including one or more amino acid substitutions located at a position corresponding to one or more of amino acid positions 19, 20, 87, 102, 104, 105, 106, 109, 112 and 114 of a wild type Human coxsackievirus 3C protease; a Human enterovirus 3C protease including one or more amino acid substitutions located at a position corresponding to one or more of amino acid positions 19, 20, 104, 105, 106 and 109 of a wild type Human enterovirus 3C protease; a Human poliovirus 3C protease including one or more amino acid substitutions located at a position corresponding to one or more of amino acid positions 19, 20, 100, 119, 121, 128 and 130 of a wild type Human poliovirus 3C protease; and/or wherein the modified picornavirus 3C protease is a Human rhinovirus 3C protease including one or more amino acid substitutions located at a position corresponding to one or more of amino acid positions 19, 20, 87, 88, 102, 104, 108, 112 and 114 of a wild type Human rhinovirus 3C protease; a Hepatitis A virus 3C protease including one or more amino acid substitutions located at a position corresponding to one or more of amino acid positions 19, 20, 100, 119, 121, 128 and 130 of a wild type Human hepatitis 3C protease. Modified 3C proteases encoded by such isolated polynucleotides are also contemplated.

Exemplary Wild Type Sequences

In some embodiments, an isolated polynucleotide sequence encoding a parent picornavirus 3C protease or a parent picornavirus 3C protease is modified to produce the isolated polynucleotides encoding the modified picornavirus 3C proteases and/or the modified picornavirus 3C proteases of the present disclosure. In some embodiments, a parent polynucleotide or parent polypeptide to be modified may be obtained or derived from any wild type picornavirus 3C protease, such as from any picornavirus genus, species, subtype, idiotype, strain and/or isolate known in the art and provided herein. For example, the parent polynucleotides encoding for a parent picornavirus 3C proteases or a parent picornavirus 3C protease may be obtained or derived from any of the picornavirus genera including Aphthovirus, Aquamavirus, Avihepatovirus, Cardiovirus, Cosavirus, Dicipivirus, Enterovirus, Erbovirus, Hepatovirus, Kobuvirus Megrivirus, Parechovirus, Piscevirus, Salivirus, Sapelovirus, Senecavirus, Teschovirus and Tremovirus. Particularly suitable genera include Aphthovirus, Enterovirus and Hepatovirus.

Particularly suitable species within the Aphihovirus genus from which a parent polynucleotide encoding a 3C protease or a parent 3C protease may be obtained or derived to produce the isolated polynucleotide encoding the modified picornavirus 3C protease of the present disclosure and/or the present modified picornavirus 3C proteases include any serotype, subtype, topotype and/or strain within a serotype of FMD, e.g., the A, O, C, Asia 1, SAT1, SAT2 and SAT3 serotypes, Bovine rhinitis A virus, such as from strain sd-1, Bovine rhinitis B virus and Equine rhinitis A virus. Particular examples of suitable wild-type FMDV 3C proteases include those set forth in SEQ ID NO: 2 (A Turkey 2006), SEQ ID NO: 4 (A24 Cruzeiro iso71), SEQ ID NO: 6 (Asia Lebanon 89, serotype Asia 1), SEQ ID NO: 8 (Asial Shamir), SEQ ID NO: 10 (C3 Indaial), SEQ ID NO: 12 (01 PanAsia), SEQ ID NO: 14 (01 Manisa isolate 87 strain, serotype O), SEQ ID NO: 16 (SAT1-20 iso11), SEQ ID NO: 18 (SAT2 Egypt 2010) and SEQ ID NO: 20 (SAT3 ZIM/6/91). Examples of suitable parent FMDV polynucleotide 3C protease sequences include those set forth in SEQ ID NOS: 1, 3, 5, 7, 9, 11, 13, 15, 17 and 19, which encode SEQ ID NOS: 2, 4, 6, 8, 10, 12, 14, 16, 18 and 20, respectively. Examples of wild type Bovine rhinitis 3C proteases that may be used as a parent 3C protease include SEQ ID NO: 422 (Bovine rhinitis A virus) and SEQ ID NO: 434 (Bovine rhinitis B virus). Examples of suitable parent Bovine rhinitis polynucleotide 3C protease sequences include those set forth in SEQ ID NOS: 421 (Bovine rhinitis A virus) and 433 (Bovine rhinitis B virus). An example of a wild type Equine rhinitis 3C protease that may be used as a parent includes SEQ ID NO: 444. An example of a suitable parent Equine rhinitis polynucleotide 3C protease sequence include that set forth as SEQ ID NOS: 443.

Particularly suitable Enterovirus species from which a parent polynucleotide encoding a 3C protease or a parent 3C protease may be obtained or derived from species including Enterovirus A, Enterovirus B, Enterovirus C, Rhinovirus A and Rhinovirus B. Suitable Enterovirus A serotypes and strains include Human coxsackievirus A10, such as the Kowalik strain and Human enterovirus A71, such as Human Enterovirus A71, C4 strain. Suitable Enterovirus B serotypes and strains include Human Coxsackievirus B1, Human Coxsackievirus B3, such as the Macocy strain and Human Coxsackievirus B5, such as swine vesicular disease virus, e.g. a parent 3C protease, such as wild type swine vesicular disease virus 3C protease as set forth in SEQ ID NO: 640. Suitable Enterovirus C serotypes, strains and isolates include Human Coxsackievirus A1, such as the Tompkins strain, Human Poliovirus 1, such as the Mahoney strain, Human Poliovirus 2, such as strain R93152 and Human Poliovirus 3, such as Isolate CHN5275/JX/CHN/2001. Particularly suitable Rhinovirus A serotypes and strains include Human rhinovirus A2, Human rhinovirus A20, such as strain VR1130 and Human rhinovirus A89, such as strain RI 199. Suitable Rhinovirus B serotypes include Human rhinovirus B14. Particularly suitable Hepatovirus species include Human hepatitis A Virus.

Specific examples of suitable parent Enterovirus 3C proteases include a wild type Human coxsackievirus A10 3C protease set forth as SEQ ID NO: 478, a wild type Human coxsackievirus B1 3C protease set forth as SEQ ID NO: 480, a wild type Human coxsackievirus B3 3C protease set forth as SEQ ID NO: 510, a wild type Human coxsackievirus A1 3C protease set forth as SEQ ID NO: 462 and a wild type Human enterovirus A71 3C protease set forth as SEQ ID NO: 526. A particularly suitable Human hepatitis A Virus for use as a parent is set forth as SEQ ID NO: 538.

Examples of suitable parent polynucleotides encoding Enterovirus 3C proteases include those encoding a wild type Human coxsackievirus A10 3C protease set forth as SEQ ID NO: 477, a wild type Human coxsackievirus B1 3C protease set forth as SEQ ID NO: 479, a wild type Human coxsackievirus B3 3C protease set forth as SEQ ID NO: 509, a wild type Human coxsackievirus A1 3C protease set forth as SEQ ID NO: 461, a wild type Human enterovirus A71 3C protease set forth as SEQ ID NO: 525 and a wild type swine vesicular disease virus 3C protease as set forth in SEQ ID NO: 439. A particularly suitable Human hepatitis A Virus for use as a parent is set forth as SEQ ID NO: 537.

Other suitable picornaviruses that may be used to obtain or derive parent picornavirus 3C proteases suitable for modification include those from the Teschovirus genus, such as a Porcine Teschovirus 3C protease, as set forth in SEQ ID NO: 636, for example, and the Senecavirus genus, such as a Seneca Valley virus 3C protease as set forth in SEQ ID NO: 638. An example of a suitable parent polynucleotide encoding a Porcine Teschovirus 3C protease includes a wild type Porcine Teschovirus 3C protease set forth as SEQ ID NO: 635. An example of a suitable parent polynucleotide encoding a Seneca Valley virus 3C protease includes a wild type Seneca Valley virus 3C protease set forth as SEQ ID NO: 637.

The wild type 3C protease sequences and the isolated polynucleotides encoding the wild type 3C proteases described above and throughout the present disclosure may be used in any of the embodiments described herein as either a parent picornavirus 3C protease, which is modified to achieve a modified picornavirus 3C protease and/or an isolated polynucleotide encoding the modified picornavirus 3C protease of the present disclosure and/or as, e.g., a template for alignment to determine positions in a picornaviral 3C protease corresponding to e.g., wild type FMDV 3C protease amino acid positions 16-25, 99-100 and 115-130 or the codons encoding such positions.

Determination of Corresponding Positions

The position(s) in the parent picornavirus 3C protease corresponding to amino acid position(s) 16-25, 99-100 and 115-130 of a wild-type FMDV 3C protease, for example, may be determined using comparative modeling. In these embodiments, a 3-dimensional model of a parent 3C protease may be constructed from the primary amino acid sequence on the basis of the known three-dimensional structure of an FMDV 3C protease. In order to be able to construct a model, it is normally desirable that the parent picornavirus 3C protease displays at least 30% sequence identity with the e.g., FMDV 3C protease. The model structure may be constructed using any suitable software known in the art, e.g., Modeller (Andrej Sali, Roberto Sanchez, Azat Badretdinov, András Fiser, and Eric Feyfant, The Rockefeller University, 1230 York Avenue, New York, N.Y. 10021-6399, USA) or WHAT IF: A molecular modeling and drug design program (G. Vriend, *J. Mol. Graph.* (1990) 8, 52-56), which is herein incorporated by reference in its entirety. Comparative models so generated can be scored for three dimensional structural similarity to the structure of an FMDV 3C protease. For example, a program such as TM align, the DALI server (e.g., DaliLite v.3 available at ekhidna.biocenter.helsinki.fi/dali_server) or the cealign algorithm implemented in PyMOL (e.g., version 1.7.6 available at www.pymol.org) can be used to assess structural similarity by calculating a TM align score, Z-score, or an RMSD value respectively.

More typically, however, the corresponding position(s) are conveniently determined on the basis of an alignment between one or more primary amino acid sequence(s) obtained or derived from one or more parent picornavirus 3C protease(s), typically wild type 3C proteases, and one or more primary amino acid sequence(s) obtained or derived from one or more wild type 3C proteases, such as one or more wild type FMDV 3C protease(s). The primary amino acid sequence(s) can be aligned by any method known to those of skill in the art. Such methods typically maximize matches and include methods using manual alignments and/or use any of the numerous alignment programs available (e.g., BLASTP and CLUSTALW version 1.74 using default parameters (Thompson et al., 1994, CLUSTAL W: "Improving the sensitivity of progressive multiple sequence alignment through sequence weighting, position-specific gap penalties and weight matrix choice", *Nucleic Acids Research,* 22:4673-4680)), which is herein incorporated by reference in its entirety. In some embodiments, Clone Manager 9, Professional Edition, Version 9.4, 1 Jan. 2015, using Blossum 62 with default parameters, is used to prepare the alignments to determine the corresponding amino acid(s) that may be substituted in a parent 3C protease to achieve the modified 3C protease encoded by the isolated polynucleotide of the present disclosure and/or to achieve a modified 3C protease of the present disclosure.

Examples of Corresponding Positions

Figure 4:
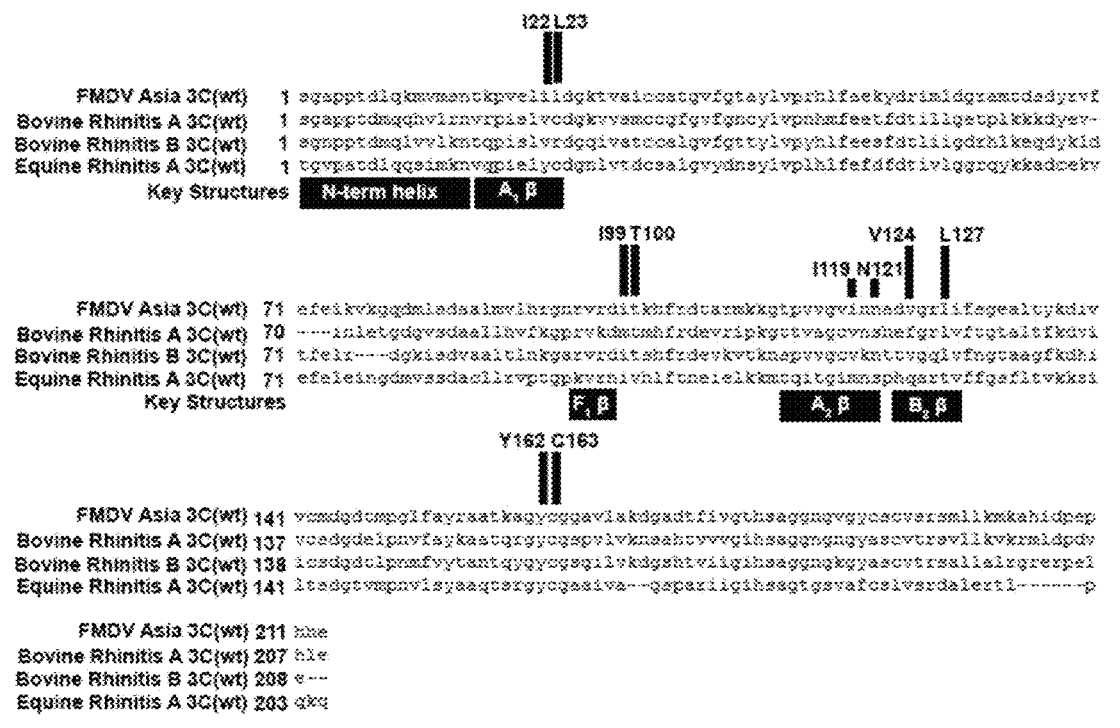

In some embodiments, the modified picornavirus 3C protease encoded by the isolated polynucleotide of the present disclosure and/or the present modified 3C proteases is a parent picornavirus 3C protease modified to include one or more amino acid substitutions located at position(s) corresponding to amino acid positions 16-25, such as amino acid positions 22 and 23, of a wild-type FMDV 3C protease. Examples of amino acid positions in a parent picornavirus 3C protease corresponding to positions 22 and 23 of a wild type FMDV 3C protease include, for example, I22 and L23, respectively, of a wild type Aphthovirus 3C protease, such as a wild type FMDC 3C protease, V22 and C23, respectively, of a wild type Aphthovirus 3C protease, such as a wild type Bovine rhinitis A virus 3C protease, V22 and R23, respectively, of a wild type Aphthovirus 3C protease, such as a wild type Bovine rhinitis B virus 3C protease and Y22 and C23, respectively, of a wild type Aphthovirus 3C protease, such as a wild type Equine rhinitis A virus 3C protease. See, e.g., FIG. 4 depicting an alignment between a wild type FMDV 3C protease, a Bovine rhinitis A virus 3C protease, a Bovine rhinitis B virus 3C protease and an Equine rhinitis A virus 3C protease.

In some embodiments, the modified picornavirus 3C protease encoded by the isolated polynucleotide and/or the modified 3C proteases of the present disclosure is a picornavirus 3C protease including one or more amino acid substitutions located at position(s) corresponding to amino acid positions 16-25, such as amino acid positions 20 and 21, of a wild-type FMDV 3C protease. Examples of amino acid positions in a parent picornavirus 3C protease corresponding to positions 20 and 21 of a wild type FMDV 3C protease include, for example, Q19 and T20, respectively, of a wild type Enterovirus A 3C protease, such as a wild type Human coxsackievirus A10 3C protease and Q19 and T20, respectively, of a wild type Enterovirus A 3C protease, such as a wild type Human enterovirus A71 3C protease. See, e.g., FIG. 5 and FIG. 6.

Figure 7:
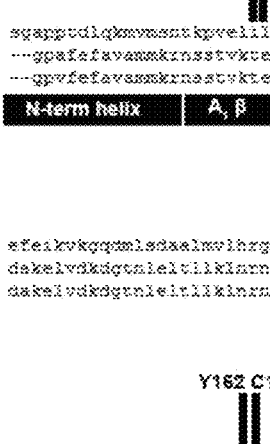
FIG. 7 depicts an alignment of wild type 3C proteases from FMDV (SEQ ID NO: 8), coxsackievirus B3 (SEQ ID NO: 510) and coxsackievirus B1 (SEQ ID NO: 494) as described in the detailed description and Example 3. Selected secondary structures are also identified.

In other embodiments, positions corresponding to amino acid positions 20 and 21 of a wild-type FMDV 3C protease include, for example, K19 and T20, respectively, of a wild type Enterovirus B 3C protease, such as a wild type Human coxsackievirus B1 or B3 3C protease. See, e.g., FIG. 7.

Examples of amino acid positions in a parent picornavirus 3C protease corresponding to positions 21 and 22 of a wild type FMDV 3C protease further include, for example, T19 and T20, respectively, of a wild type Enterovirus C 3C protease, such as a wild type Human coxsackievirus A1 3C protease and a wild type Human poliovirus 3C protease. See, e.g., FIG. 5 and FIG. 8.

In other embodiments, positions corresponding to amino acid positions 21 and 22 of a wild-type FMDV 3C protease include, for example, T19 and T20, respectively, of a wild type Rhinovirus A 3C protease. See, e.g., FIG. 9.

In some embodiments, the modified picornavirus 3C protease encoded by the isolated polynucleotide and/or the modified 3C proteases of the present disclosure is a picornavirus 3C protease including one or more amino acid substitutions located at position(s) corresponding to amino acid positions 16-25, such as amino acid positions 16 and 17, of a wild-type FMDV 3C protease. Examples of amino acid positions in a parent picornavirus 3C protease corresponding to positions 16 and 17 of a wild type FMDV 3C protease include, for example, T19 and T20, respectively, of a wild type Rhinovirus B 3C protease. See, e.g., FIG. 10.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 16-25, such as amino acid positions 16, 17, 24 and 25, of a wild-type FMDV 3C protease. Examples of amino acid positions in a parent picornavirus 3C protease corresponding to positions 16, 17, 24 and 25 of a wild type FMDV 3C protease include, for example, G17, V18, G19 and E20, respectively, of a wild type Hepatitis A virus 3C protease. See, e.g., FIG. 11.

In some embodiments, the modified picornavirus 3C protease encoded by the isolated polynucleotide and/or the modified picornavirus 3C protease of the present disclosure includes one or more amino acid substitution(s) located at position(s) corresponding to amino acid positions 115-130, such as amino acid positions 123-128, of a wild-type FMDV 3C protease. Examples of positions in picornavirus 3C proteases corresponding to amino acid positions 123-126 and 128 of wild type FMDV 3C protease include D123, V124, G125, R126 and I128, respectively, of a wild type Aphthovirus 3C protease, such as a wild type FMDV 3C protease.

In some embodiments, the modified picornavirus 3C protease encoded by the isolated polynucleotide and/or the modified picornavirus 3C protease of the present disclosure includes one or more amino acid substitution(s) located at position(s) corresponding to amino acid positions 115-130, such as amino acid positions 127 and 128, of a wild-type FMDV 3C protease. Examples of positions in picornavirus 3C proteases corresponding to amino acid positions 124 and 127 of a wild type FMDV 3C protease include F120 and L123, respectively, of a wild type Aphthovirus 3C protease, such as a wild type Bovine rhinitis A virus 3C protease. See, e.g., FIG. 4.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 124 and 127, of a wild-type FMDV 3C protease. Examples of positions in picornavirus 3C proteases corresponding to amino acid positions 124 and 127 include V121 and L124, respectively, of a wild type Aphthovirus 3C protease, such as a wild type Bovine rhinitis B virus 3C protease. See, e.g., FIG. 4.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 125 and 127, of a wild-type FMDV 3C protease. Examples of positions in picornavirus 3C proteases corresponding to amino acid positions 125 and 127 include A 125 and T127, respectively, of a wild type Aphthovirus 3C protease, such as a wild type Equine rhinitis A 3C protease. See, e.g., FIG. 4.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 117, 119, 124 and 127, of a wild-type FADV 3C protease. Examples of amino acid positions in picornavirus 3C proteases corresponding to amino acid positions 117, 120, 124 and 127 include L102, I104, N105, M109 and M112, respectively, of a wild type Enterovirus A 3C protease, such as Human coxsackievirus A10. See, e.g., FIG. 5.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 119, 120, 121 and 124, of a wild-type FMDV 3C protease. Examples of amino acid positions in picornavirus 3C proteases corresponding to amino acid positions 119, 120, 121 and 124 include I104, N105, T106 and M109, respectively, of a wild type Enterovirus A 3C protease, such as Human enterovirus A71. See, e.g., FIG. 6.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 116, 118, 119, 120, 123, 126 and 128 of a wild-type FMDV 3C protease. Examples of amino acid positions in picornavirus 3C proteases corresponding to amino acid positions 116, 118, 119, 120, 123, 126 and 128 include L102, I104, N105, T106, F109, M112 and I114, respectively, of a wild type Enterovirus B 3C protease, such as Human coxsackievirus B. See, e.g., FIG. 7.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 117, 119, 120, 124 and 127 of a wild-type FMDV 3C protease. Examples of amino acid positions in picornavirus 3C proteases corresponding to amino acid positions 117, 119, 120, 124 and 127 include L1102, V104, N105, T106, F109 and M112 respectively, of a wild type Enterovirus C 3C protease, such as Human coxsackievirus A1. See, e.g., FIG. 5.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 117, 118 and 119 of a wild-type FMDV 3C protease. Examples of amino acid positions in picornavirus 3C proteases corresponding to amino acid positions 117, 118 and 119 include L102, I103, and V104, respectively, of a wild type Enterovirus C 3C protease, such as Human poliovirus. See, e.g., FIG. 8.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 116, 118, 122, 126 and 128, of a wild-type FMDV 3C protease. Examples of positions in picornavirus 3C proteases corresponding to amino acid positions 116, 118, 122, 126 and 128 include L102, L104, Q108, T112 and I114, respectively, of a wild type Rhinovirus A 3C protease. See, e.g., FIG. 9.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 125 and 127 of a wild-type FMDV 3C protease. Examples of amino acid positions in picornavirus 3C proteases corresponding to amino acid positions 128 and 130 include I112 and E114, respectively, of a wild type E Rhinovirus B 3C protease. See, e.g., FIG. 10.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 115-130, such as amino acid positions 115, 117, 124 and 128 of a wild-type FMDV 3C protease. Examples of amino acid positions in picornavirus 3C proteases corresponding to amino acid positions 115, 117, 124 and 128 include L119, T121, M128 and I130, respectively, of a wild type Hepatitis A virus 3C protease. See, e.g., FIG. 11.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 99 and 100 of a wild-type FMDV 3C protease. Examples of positions in picornavirus 3C proteases corresponding to position 99 includes I99 and L99 of a wild type Aphthovirus 3C protease, such as a wild type FMDV 3C protease. Examples of positions in picornavirus 3C proteases corresponding to position 100 includes T100 of a wild type Aphthovirus 3C protease, such as a wild type FMDV 3C protease. See, e.g., FIG. 4 and FIG. 12.

In some embodiments, the modified picornavirus 3C protease encoded by the isolated polynucleotide and/or the modified picornavirus 3C protease of the present disclosure includes one or more amino acid substitutions located at position(s) corresponding to amino acid positions 99 and 100, such as amino acid position 100, of a wild-type FMDV 3C protease. Examples of positions in picornavirus 3C proteases corresponding to position 100 includes T96 of a wild type Aphihovirus 3C protease, such as a wild type Bovine rhinitis A virus 3C protease. T97 of a wild type Aphthovirus 3C protease, such as a wild type Bovine rhinitis A virus 3C protease and V100 of a wild type Aphthovirus 3C protease, such as a wild type Equine rhinitis A virus 3C protease. See, e.g., FIG. 4 and FIG. 12.

In other embodiments, positions corresponding to amino acid position 100 of a wild-type FMDV 3C protease includes, for example, T87 of a wild type Enterovirus A 3C protease, such as a wild type Human coxsackievirus A10 3C protease and a wild type Human enterovirus A71 protease. See, e.g., FIG. 5, FIG. 6 and FIG. 12.

In other embodiments, positions corresponding to amino acid position 100 of a wild-type FMDV 3C protease includes, for example, R87 of a wild type Enterovirus B 3C protease, such as a wild type Human coxsackievirus B1 or B3 3C protease. See, e.g., FIG. 12.

In other embodiments, positions corresponding to amino acid position 100 of a wild-type FMDV 3C protease include, for example, R87 of a wild type Enterovirus C 3C protease, such as a wild type coxsackievirus A1 3C protease and a wild type Human poliovirus 3C protease. See, e.g., FIG. 5, FIG. 8 and FIG. 12.

In other embodiments, positions corresponding to amino acid positions 99 and 100 of a wild-type FMDV 3C protease includes, for example, 186 and R87, respectively, of a wild type Rhinovirus A 3C protease. See, e.g., FIG. 9 and FIG. 12.

In other embodiments, positions corresponding to amino acid position 99 and 100 of a wild-type FMDV 3C protease includes, for example, 186 and R87, respectively, of a wild type Rhinovirus B 3C protease. See, e.g., FIG. 10 and FIG. 12.

In other embodiments, positions corresponding to amino acid position 100 of a wild-type FMDV 3C protease includes, for example, T100 of a wild type Hepatitis A virus 3C protease. See, e.g., FIG. 11 and FIG. 12.

Exemplary Positions of Amino Acid Substitutions

In some aspects, the present disclosure is directed to an isolated polynucleotide encoding a modified picornavirus 3C protease, such as a wild type Aphthovirus 3C protease, such as a wild type FMDC 3C protease, wherein the modified picornavirus 3C protease comprises one or more amino acid substitutions at positions I22 and L23. In other aspects, the present disclosure is directed to a modified picornavirus 3C protease, such as a modified Aphthovirus 3C protease, such as a modified FMDC 3C protease comprising one or more amino acid substitutions located at positions I22 and L23.

In some aspects, the present disclosure is directed to an isolated polynucleotide encoding a modified picornavirus 3C protease, such as a wild type Aphthovirus 3C protease, such as a wild type Bovine rhinitis A virus 3C protease, wherein the modified picornavirus 3C protease comprises one or more amino acid substitutions at positions V22 and C23. In other aspects, the present disclosure is directed to a modified picornavirus 3C protease, such as a modified Aphthovirus 3C protease, such as a modified Bovine rhinitis A virus 3C protease comprising the one or more amino acid substitutions located at positions V22 and C23.

In some aspects, the present disclosure is directed to an isolated polynucleotide encoding a modified picornavirus 3C protease, such as a wild type Aphthovirus 3C protease, such as a wild type Bovine rhinitis B virus 3C protease, wherein the modified picornavirus 3C protease comprises one or more amino acid substitutions at Y22 and R23. In other aspects, the present disclosure is directed to a modified picornavirus 3C protease, such as a modified Aphthovirus 3C protease, such as a modified Bovine rhinitis B virus 3C protease comprising the one or more amino acid substitutions located at positions Y22 and R23.

In some aspects, the present disclosure is directed to an isolated polynucleotide encoding a modified picornavirus 3C protease, such as a wild type Aphthovirus 3C protease, such as a wild type Equine rhinitis A virus 3C protease, wherein the modified picornavirus 3C protease comprises one or more amino acid substitutions at positions Y22 and C23. In other aspects, the present disclosure is directed to a modified picornavirus 3C protease, such as a modified Aphthovirus 3C protease, such as a modified Equine rhinitis A virus 3C protease comprising the one or more amino acid substitutions located at positions Y22 and C23.

In some aspects, the present disclosure is directed to an isolated polynucleotide encoding a modified picornavirus 3C protease, such as a wild type Enterovirus A 3C protease, such as a wild type Human coxsackievirus A10 3C protease, wherein the modified picornavirus 3C protease comprises one or more amino acid substitutions at positions Q19 and T20. In other aspects, the present disclosure is directed to a modified picornavirus 3C protease, such as a modified Enterovirus A 3C protease, such as a modified Human coxsackievirus A10 3C protease comprising the one or more amino acid substitutions located at positions Q19 and T20.

In some aspects, the present disclosure is directed to an isolated polynucleotide encoding a modified picornavirus 3C protease, such as a wild type Enterovirus A 3C protease, such as a wild type Human enterovirus A71 3C protease, wherein the modified picornavirus 3C protease comprises one or more amino acid substitutions at positions Q19 and T20. In other aspects, the present disclosure is directed to a modified picornavirus 3C protease, such as a modified Enterovirus A 3C protease, such as a modified Human enterovirus A71 3C protease comprising the one or more amino acid substitutions located at positions Q19 and T20.

In some aspects, the present disclosure is directed to an isolated polynucleotide encoding a modified picornavirus 3C protease, such as a wild type Enterovirus B 3C protease, such as a wild type Human coxsackievirus B1 and/or B3 3C protease, wherein the modified picornavirus 3C protease comprises one or more amino acid substitutions at positions K19 and T20. In other aspects, the present disclosure is directed to a modified picornavirus 3C protease, such as a modified Enterovirus B protease, such as a modified Human coxsackievirus B1 and/or B3 3C protease comprising the one or more amino acid substitutions located at positions K19 and T20.

In some aspects, the present disclosure is directed to an isolated polynucleotide encoding a modified picornavirus 3C protease, such as an Enterovirus C 3C protease, such as a wild type Human coxsackievirus A1 3C protease and/or a wild type Human poliovirus 3C protease, wherein the modified picornavirus 3C protease comprises one or more amino acid substitutions at positions T19 and T20. In other aspects, the present disclosure is directed to a modified picornavirus 3C protease, such as a modified Enterovirus C 3C protease, such as a modified Human coxsackievirus A1 3C protease and/or a modified Human poliovirus 3C protease comprising the one or more amino acid substitutions located at positions T19 and T20.

In some aspects, the present disclosure is directed to an isolated polynucleotide encoding a modified picornavirus 3C protease, such as a wild type Rhinovirus A 3C protease, wherein the modified picornavirus 3C protease comprises one or more amino acid substitutions at positions T19 and T20. In other aspects, the present disclosure is directed to a modified picornavirus 3C protease, such as a modified Rhinovirus A 3C protease comprising the one or more amino acid substitutions located at positions T19 and T20.

In some aspects, the present disclosure is directed to an isolated polynucleotide encoding a modified picornavirus 3C protease, such as a wild type Rhinovirus B 3C protease, wherein the modified picornavirus 3C protease comprises one or more amino acid substitutions at positions T19 and T20. In other aspects, the present disclosure is directed to a modified picornavirus 3C protease, such as a modified Rhinovirus B 3C protease comprising the one or more amino acid substitutions located at positions T19 and T20.

In some aspects, the present disclosure is directed to an isolated polynucleotide encoding a modified picornavirus 3C protease, such as a wild type Hepatitis A virus 3C protease, wherein the modified picornavirus 3C protease comprises one or more amino acid substitutions at positions G19 and T20. In other aspects, the present disclosure is directed to a modified picornavirus 3C protease, such as a modified Hepatitis A virus 3C protease comprising the one or more amino acid substitutions located at positions G19 and G20.

In some aspects, the present disclosure is directed to an isolated polynucleotide encoding a modified picornavirus 3C protease, such as a wild type Aphthovirus 3C protease, such as a wild type FMDC 3C protease, wherein the modified picornavirus 3C protease comprises one or more amino acid substitutions at positions D123, V124, G125, R126 and I128. In other aspects, the present disclosure is directed to a modified picornavirus 3C protease, such as a modified Aphthovirus 3C protease, such as a modified FMDC 3C protease comprising the one or more amino acid substitutions located at positions D123, V124, G125, R126 and I128.

In some aspects, the present disclosure is directed to an isolated polynucleotide encoding a modified picornavirus 3C protease, such as a wild type Aphthovirus 3C protease, such as a wild type Bovine rhinitis A virus 3C protease, wherein the modified picornavirus 3C protease comprises one or more amino acid substitutions at positions F120 and L123. In other aspects, the present disclosure is directed to a modified picornavirus 3C protease, such as a modified Aphthovirus 3C protease, such as a modified Bovine rhinitis A virus 3C protease comprising the one or more amino acid substitutions located at positions F120 and L123.

In some aspects, the present disclosure is directed to an isolated polynucleotide encoding a modified picornavirus 3C protease, such as a wild type Aphthovirus 3C protease, such as a wild type Bovine rhinitis B virus 3C protease, wherein the modified picornavirus 3C protease comprises one or more amino acid substitutions at positions V121 and L124. In other aspects, the present disclosure is directed to a modified picornavirus 3C protease, such as a modified Aphthovirus 3C protease, such as a modified Bovine rhinitis B virus 3C protease comprising the one or more amino acid substitutions located at positions V121 and L124.

In some aspects, the present disclosure is directed to an isolated polynucleotide encoding a modified picornavirus 3C protease, such as a wild type Aphthovirus 3C protease, such as a wild type Equine rhinitis A virus 3C protease, wherein the modified picornavirus 3C protease comprises one or more amino acid substitutions at positions A125 and T127. In other aspects, the present disclosure is directed to a modified picornavirus 3C protease, such as a modified Aphthovirus 3C protease, such as a modified Equine rhinitis A virus 3C protease comprising the one or more amino acid substitutions located at positions A125 and T127.

In some aspects, the present disclosure is directed to an isolated polynucleotide encoding a modified picornavirus 3C protease, such as a wild type Enterovirus A 3C protease, such as a wild type Human coxsackievirus A10 3C protease, wherein the modified picornavirus 3C protease comprises one or more amino acid substitutions at positions L102, I104, N105, M109 and M112. In other aspects, the present disclosure is directed to a modified picornavirus 3C protease, such as a modified Enterovirus A 3C protease, such as a modified Human coxsackievirus A10 3C protease comprising the one or more amino acid substitutions located at positions L102, I104, N105, M109 and M112.

In some aspects, the present disclosure is directed to an isolated polynucleotide encoding a modified picornavirus 3C protease, such as a wild type Enterovirus A 3C protease, such as a wild type Human enterovirus A71 3C protease, wherein the modified picornavirus 3C protease comprises one or more amino acid substitutions at positions I104, N105, T106 and M109. In other aspects, the present disclosure is directed to a modified picornavirus 3C protease, such as a modified Enterovirus A 3C protease, such as a modified Human enterovirus A71 3C protease comprising the one or more amino acid substitutions located at positions I104, N105, T106 and M109.

In some aspects, the present disclosure is directed to an isolated polynucleotide encoding a modified picornavirus 3C protease, such as a wild type Enterovirus B 3C protease, such as a wild type Human coxsackievirus B1 and/or B3 3C protease, wherein the modified picornavirus 3C protease comprises one or more amino acid substitutions at positions L102, I104, N105, T106, F109, M112 and I114. In other aspects, the present disclosure is directed to a modified picornavirus 3C protease, such as a modified Enterovirus B protease, such as a modified Human coxsackievirus B1 and/or B3 3C protease comprising the one or more amino acid substitutions located at positions L102, I104, N105, T106, F109, M112 and I114.

In some aspects, the present disclosure is directed to an isolated polynucleotide encoding a modified picornavirus 3C protease, such as an Enterovirus C 3C protease, such as a wild type Human coxsackievirus A1 3C protease, wherein the modified picornavirus 3C protease comprises one or more amino acid substitutions at positions L102, V104, N105, T106, F109 and M112. In other aspects, the present disclosure is directed to a modified picornavirus 3C protease, such as a modified Enterovirus C 3C protease, such as a modified Human coxsackievirus A1 3C protease comprising the one or more amino acid substitutions located at positions L102, V104, N105, T106, F109 and M112.

In some aspects, the present disclosure is directed to an isolated polynucleotide encoding a modified picornavirus 3C protease, such as an Enterovirus C 3C protease, such as a wild type Human poliovirus 3C protease, wherein the modified picornavirus 3C protease comprises one or more amino acid substitutions at positions L102, I103, and V104. In other aspects, the present disclosure is directed to a modified picornavirus 3C protease, such as a modified Enterovirus C 3C protease, such as a modified Human poliovirus 3C protease comprising the one or more amino acid substitutions located at positions L102, I103, and V104.

In some aspects, the present disclosure is directed to an isolated polynucleotide encoding a modified picornavirus 3C protease, such as a wild type Rhinovirus A 3C protease, wherein the modified picornavirus 3C protease comprises one or more amino acid substitutions at positions L102, L104, Q108, T112 and I114. In other aspects, the present disclosure is directed to a modified picornavirus 3C protease, such as a modified RhinovirusA 3C protease comprising the one or more amino acid substitutions located at positions L102, L104, Q108, T112 and I114.

In some aspects, the present disclosure is directed to an isolated polynucleotide encoding a modified picornavirus 3C protease, such as a wild type Rhinovirus B 3C protease, wherein the modified picornavirus 3C protease comprises one or more amino acid substitutions at positions I1112 and E114. In other aspects, the present disclosure is directed to a modified picornavirus 3C protease, such as a modified Rhinovirus B 3C protease comprising the one or more amino acid substitutions located at positions I112 and E114.

In some aspects, the present disclosure is directed to an isolated polynucleotide encoding a modified picornavirus 3C protease, such as a wild type Hepatitis A virus 3C protease, wherein the modified picornavirus 3C protease comprises one or more amino acid substitutions at positions L119, T121, M128 and I130. In other aspects, the present disclosure is directed to a modified picornavirus 3C protease, such as a modified Hepatitis A virus 3C protease comprising the one or more amino acid substitutions located at positions L119, T121, M128 and I130.

In some aspects, the present disclosure is directed to an isolated polynucleotide encoding a modified picornavirus 3C protease, such as a wild type Aphthovirus 3C protease, such as a wild type FMDC 3C protease, wherein the modified picornavirus 3C protease comprises one or more amino acid substitutions at positions I99, L99 and T100. In other aspects, the present disclosure is directed to a modified picornavirus 3C protease, such as a modified Aphthovirus 3C protease, such as a modified FMDC 3C protease comprising the one or more amino acid substitutions located at positions I99, L99 and T100.

In some aspects, the present disclosure is directed to an isolated polynucleotide encoding a modified picornavirus 3C protease, such as a wild type Aphthovirus 3C protease, such as a wild type Bovine rhinitis A virus 3C protease, wherein the modified picornavirus 3C protease comprises one or more amino acid substitutions at position T96. In other aspects, the present disclosure is directed to a modified picornavirus 3C protease, such as a modified Aphthovirus 3C protease, such as a modified Bovine rhinitis A virus 3C protease comprising the one or more amino acid substitutions located at position T96.

In some aspects, the present disclosure is directed to an isolated polynucleotide encoding a modified picornavirus 3C protease, such as a wild type Aphthovirus 3C protease, such as a wild type Bovine rhinitis B virus 3C protease, wherein the modified picornavirus 3C protease comprises one or more amino acid substitutions at position T97. In other aspects, the present disclosure is directed to a modified picornavirus 3C protease, such as a modified Aphthovirus 3C protease, such as a modified Bovine rhinitis B virus 3C protease comprising the one or more amino acid substitutions located at position T97.

In some aspects, the present disclosure is directed to an isolated polynucleotide encoding a modified picornavirus 3C protease, such as a wild type Aphthovirus 3C protease, such as a wild type Equine rhinitis A virus 3C protease, wherein the modified picornavirus 3C protease comprises one or more amino acid substitutions at position V100. In other aspects, the present disclosure is directed to a modified picornavirus 3C protease, such as a modified Aphthovirus 3C protease, such as a modified Equine rhinitis A virus 3C protease comprising the one or more amino acid substitutions located at position V100.

In some aspects, the present disclosure is directed to an isolated polynucleotide encoding a modified picornavirus 3C protease, such as a wild type Enterovirus A 3C protease, such as a wild type Human coxsackievirus A10 3C protease, wherein the modified picornavirus 3C protease comprises one or more amino acid substitutions at position T87. In other aspects, the present disclosure is directed to a modified picornavirus 3C protease, such as a modified Enterovirus A 3C protease, such as a modified Human coxsackievirus A10 3C protease comprising the one or more amino acid substitutions located at position T87.

In some aspects, the present disclosure is directed to an isolated polynucleotide encoding a modified picornavirus 3C protease, such as a wild type Enterovirus A 3C protease, such as a wild type Human enterovirus A71 3C protease, wherein the modified picornavirus 3C protease comprises one or more amino acid substitutions at position T87. In other aspects, the present disclosure is directed to a modified picornavirus 3C protease, such as a modified Enterovirus A 3C protease, such as a modified Human enterovirus A71 3C protease comprising the one or more amino acid substitutions located at position T87.

In some aspects, the present disclosure is directed to an isolated polynucleotide encoding a modified picornavirus 3C protease, such as a wild type Enterovirus B 3C protease, such as a wild type Human coxsackievirus B1 and/or B3 3C protease, wherein the modified picornavirus 3C protease comprises one or more amino acid substitutions at position R87. In other aspects, the present disclosure is directed to a modified picornavirus 3C protease, such as a modified Enterovirus B protease, such as a modified Human coxsackievirus B1 and/or B3 3C protease comprising the one or more amino acid substitutions located at position R87.

In some aspects, the present disclosure is directed to an isolated polynucleotide encoding a modified picornavirus 3C protease, such as an Enterovirus C 3C protease, such as a wild type Human coxsackievirus A1 3C protease, wherein the modified picornavirus 3C protease comprises one or more amino acid substitutions at position R87. In other aspects, the present disclosure is directed to a modified picornavirus 3C protease, such as a modified Enterovirus C 3C protease, such as a modified Human coxsackievirus A1 3C protease comprising the one or more amino acid substitutions located at position R87.

In some aspects, the present disclosure is directed to an isolated polynucleotide encoding a modified picornavirus 3C protease, such as an Enterovirus C 3C protease, such as a wild type Human poliovirus 3C protease, wherein the modified picornavirus 3C protease comprises one or more amino acid substitutions at position R87. In other aspects, the present disclosure is directed to a modified picornavirus 3C protease, such as a modified Enterovirus C 3C protease, such as a modified Human poliovirus 3C protease comprising the one or more amino acid substitutions located at position R87.

In some aspects, the present disclosure is directed to an isolated polynucleotide encoding a modified picornavirus 3C protease, such as a wild type Rhinovirus A 3C protease, wherein the modified picornavirus 3C protease comprises one or more amino acid substitutions at positions I86 and R87 and I114. In other aspects, the present disclosure is directed to a modified picornavirus 3C protease, such as a modified Rhinovirus A 3C protease comprising the one or more amino acid substitutions located at positions I86, R87 and I114.

In some aspects, the present disclosure is directed to an isolated polynucleotide encoding a modified picornavirus 3C protease, such as a wild type Rhinovirus B 3C protease, wherein the modified picornavirus 3C protease comprises one or more amino acid substitutions at positions I86 and R87. In other aspects, the present disclosure is directed to a modified picornavirus 3C protease, such as a modified Rhinovirus B 3C protease comprising the one or more amino acid substitutions located at positions I86 and R87.

In some aspects, the present disclosure is directed to an isolated polynucleotide encoding a modified picornavirus 3C protease, such as a wild type Hepatitis A virus 3C protease, wherein the modified picornavirus 3C protease comprises one or more amino acid substitutions at position T100. In other aspects, the present disclosure is directed to a modified picornavirus 3C protease, such as a modified Hepatitis A virus 3C protease comprising the one or more amino acid substitutions at position T100.

Amino Acid Substitutions

Mutations resulting in the amino acid substitutions described herein may be introduced into a parent picornavirus 3C protease, such as the wild type picornavirus 3C proteases described herein or an isolated polynucleotide encoding a picornavirus 3C protease described herein, using any methodology known to those skilled in the art. Mutations may be introduced randomly, for example, by conducting a PCR reaction in the presence of manganese as a divalent metal ion cofactor. In other embodiments, oligonucleotide directed mutagenesis may be used to create the polynucleotides encoding for the modified picornavirus 3C proteases of the present disclosure, which allows for all possible classes of base pair changes at any determined site along an encoding DNA molecule. In general, this technique involves annealing an oligonucleotide complementary (except for one or more mismatches) to a single stranded nucleotide sequence coding for the parent picornavirus 3C protease of interest. The mismatched oligonucleotide is then extended by DNA polymerase, generating a double-stranded DNA molecule containing the desired amino acid substitution in sequence in one strand. The double-stranded polynucleotide can then be inserted into an appropriate expression vector, and a mutant or modified polypeptide can thus be produced. The above-described oligonucleotide directed mutagenesis or site directed mutagenesis can, optionally, be carried out via PCR.

The amino acid substitution may include any of arginine, alanine, asparagine, aspartic acid, cysteine, glutamine, glutamic acid, glycine, histidine, isoleucine, leucine, lysine, methionine, phenylalanine, proline, serine, threonine, tryptophan, tyrosine, valine, or an unnatural amino acid. For example, R87 in the 3C protease from wild type Rhinovirus B 3C protease may be replaced with an alanine, an asparagine, an aspartic acid, a cysteine, a glutamine, a glutamic acid, a glycine, a histidine, an isoleucine, a leucine, a lysine, a methionine, a phenylalanine, a proline, a serine, a threonine, tryptophan, a valine, or an unnatural amino acid.

In some embodiments, the one or more amino acid substitutions comprise one or more non-conservative substitutions. A non-conservative amino acid substitution refers to replacing an amino acid with another amino acid that has different chemical properties (such as, for example, a polarity, hydrogen bonding potential, acidic, basic, shape, hydrophobic, aromatic, and the like). Examples include replacing a hydrophobic, non-polar amino acid such as Ala, Val, Leu, Ile, Pro, Phe, Trp or Met with a hydrophilic, polar amino acid, such as Ser, Thr, Cys, Tyr, Asn or Gln, or an acidic, negatively charged amino acid such as Asp or Glu with a basic, positively charged amino acid, such as Lys, Arg or His. Other examples of non-conservative substitution include replacing amino acids between the following groups in Table 1, below.

TABLE 1

Amino Acid Side Chain Characteristics

| Side Chain Characteristic | Amino Acid |
|---|---|
| Non-polar (hydrophobic) | |
| Aliphatic | Ala, Leu, Ile, Val, Pro |
| Aromatic | Phe Trp |
| Sulfur containing | Met |
| Borderline | Gly |

TABLE 1-continued

Amino Acid Side Chain Characteristics

| Side Chain Characteristic | Amino Acid |
|---|---|
| Uncharged Polar | |
| Hydroxyl | Ser Thr Tyr |
| Amides | Asn Gln |
| Sulfhydryl | Cys |
| Borderline | Gly |
| Charged | Arg Lys Asp Glu |

In some embodiments, the one or more amino acid substitutions includes proline. As is known to an ordinary artisan, proline typically acts as a structural disrupter of secondary structure elements including alpha helices and beta sheets.

In some embodiments, the modified picornavirus 3C protease encoded by the isolated polynucleotide described herein and the present modified picornavirus 3C protease contains 1-27 such as 1-19 amino acid substitutions, for example 1-10, 1-8, 1-6 or 1-5 amino acid substitutions, such as 1-4 or 1-3 amino acid substitutions, such as 1 or 2 amino acid substitutions.

In some embodiments, the one or more amino acid substitution(s) does not alter the protein conformation and/or functional properties of the present modified picornavirus 3C proteases. More typically, however, the one or more amino acid substitution(s) alters the conformation and/or functional properties of the present modified 3C proteases. Typically, both the conformation and one or more functional property of the present 3C proteases are modified in comparison to that of a control 3C protease.

In some embodiments, the one or more amino acid substitution(s) described herein alters a secondary structure such as an alpha helix, a beta sheet, a beta strand, or a loop. Alteration of secondary structure may be determined using well known protein secondary structure prediction programs including SPIDER2, Heffernan et al., "Highly Accurate Sequence-based Prediction of Half-Sphere Exposures of Amino Acid Residues in Proteins", Bioinformatics 2016. 32: 843-849 and PSIPRED Jones D T. "Protein secondary structure prediction based on position-specific scoring matrices", J. Mol. Biol., 9, 292: 195-202, which is herein incorporated by reference in its entirety.

In some embodiments, the instant modified picornavirus 3C protease includes one or more point mutations to a nucleotide sequence encoding a picornavirus 3C protease that would result in one or more amino acid substitutions in the translated amino acid sequence, specifically one or more point mutations targeting one or more of an $A_1$-$B_1$ β sheet, an $A_2$-$B_2$ β sheet and/or a loop between an $F_1$ β strand and an $A_2$ β strand, or an $A_1$, $A_2$, $B_1$ and/or $B_2$ β strand.

In some embodiments, the one or more amino acid substitutions that alter(s), e.g., disrupts, the $A_1$-$B_1$ β sheet is/are located at position(s) corresponding to one or more of amino acid positions 16-25 of a wild type FMDV 3C protease.

In some embodiments, the one or more amino acid substitutions that alter(s), e.g., disrupts, the $A_1$-$B_1$ β sheet alter(s), e.g., disrupts the $A_1$ β sheet. Typically, the one or more amino acid substitutions that alter(s), e.g., disrupts the $A_1$ β sheet is/are located at position(s) corresponding to one or more of amino acid positions 20-23 of a wild type FMDV 3C protease.

In some embodiments, the one or more amino acid substitutions that alter(s), e.g., disrupts, the $A_1$-$B_1$ β sheet alter(s), e.g., disrupts a loop between an $A_1$ β strand and a $B_1$ β strand. Typically, the one or more amino acid substitutions that alter(s), e.g., disrupts the loop between an $A_1$ β strand and a $B_1$ β strand is/are located at position(s) corresponding to one or more of amino acid positions 24 and 25 of a wild type FMDV 3C protease.

In some embodiments, the one or more substitutions that alter(s), e.g., disrupts, the loop between the $F_1$ β strand and the $A_2$ β strand is/are located at position(s) corresponding to one or more of amino acid positions 99 and 100 of a wild type FMDV 3C protease.

In some embodiments, the one or more substitutions that alter(s), e.g., disrupts, the $A_2$-$B_2$ β sheet is/are located at position(s) corresponding to one or more of amino acid positions 115-130 of a wild type FMDV 3C protease.

In some embodiments, the one or more amino acid substitutions alters, e.g., disrupts, the $B_2$ β strand of the $A_2$-$B_2$ β sheet. In some embodiments, the $B_2$ β strand includes residues 123 to 128 of a picornavirus 3C protease, such as an FMDV 3C protease. In some embodiments, the one or more substitutions that alter(s), e.g., disrupts, the $B_2$ β strand of the $A_2$-$B_2$ β sheet is/are located at position(s) corresponding to one or more of amino acid positions 123 to 128 of a wild type FMDV 3C protease.

In some embodiments, the one or more amino acid substitutions disrupts the $B_2'$ β strand. The $B_2'$ β strand corresponds to residues 130 to 133 in species within the Apthovirus genus including Bovine rhinitis A virus, Bovine rhinitis B virus, Equine rhinitis A virus and FMDV. In some embodiments, such as species including Rhinovirus A, Rhinovirus B, and Hepatitis A, the $B'_2$ β strand is absent. For example, the $B_2$ β strand of the $A_2$-$B_2$ β sheet corresponds to residues 103 to 116 (Rhinovirus A) and residues 100 to 114 (Rhinovirus B), which are homologous to residues 117 to 130 in FMDV. In some embodiments, such as a 3C protease from Hepatitis A virus, the $B_2$ β strand of the $A_2$-$B_2$ β sheet corresponds to residues 121 to 132, which are homologous to residues 120 to 132 in FMDV Accordingly, in some embodiments, the one or more substitutions that alter(s), e.g., disrupts, the $A_2$-$B_2$ β sheet is/are located at position(s) corresponding to one or more of amino acid positions 117 to 130 of a wild type FMDV 3C protease. In other embodiments, the one or more substitutions that alter(s), e.g., disrupts, the $A_2$-$B_2$ β sheet is/are located at position(s) corresponding to one or more of amino acid positions 120 to 132 of a wild type FMDV 3C protease, such as amino acid positions 120 to 130.

In some embodiments, alteration, e.g., disruption, of a secondary structure, such as an $A_1$-$B_1$ β sheet, an $A_2$-$B_2$ β sheet and/or a loop between an $F_1$ β strand and an $A_2$ β strand, is associated with a change in a functional property in comparison to that of a control 3C protease. For example, in some embodiments, the modified picornavirus 3C protease encoded by an isolated polynucleotide of the present disclosure is capable of reduced toxicity when expressed in a host cell and/or enhanced transgene expression of a polypeptide, such as a P1 precursor polypeptide, in comparison to that of a control 3C protease. In some embodiments, the proteolytic processing ability of the modified picornavirus 3C proteases of the present disclosure is reduced in comparison to that of a control 3C protease.

Figure 1:
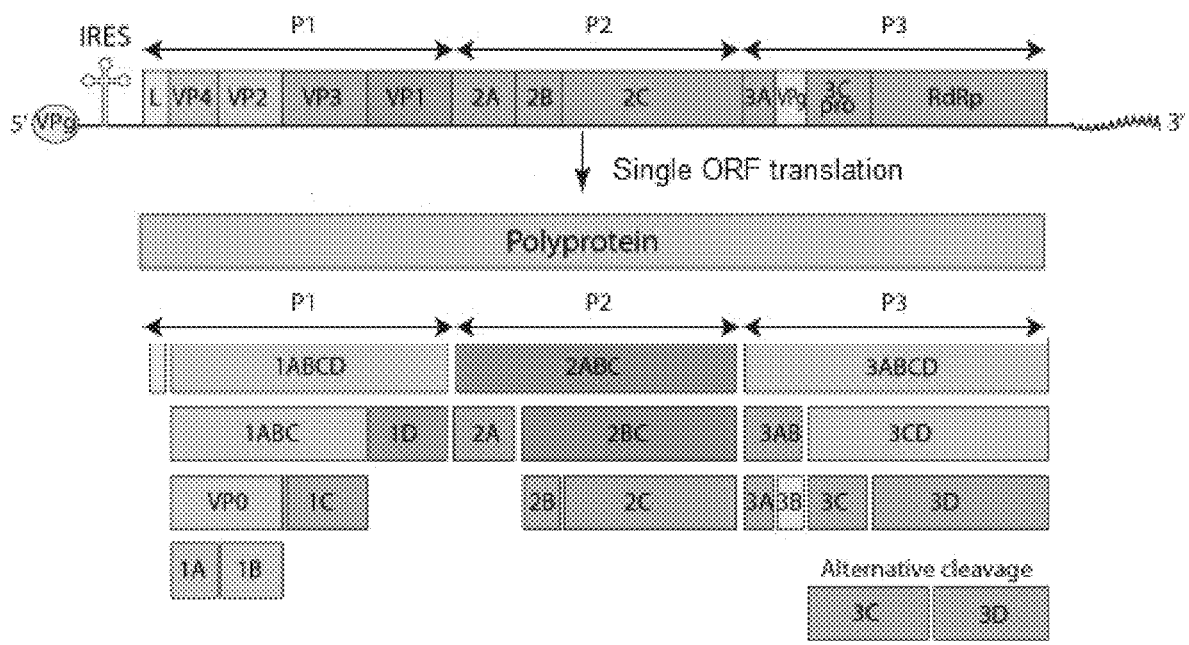
FIG. 1 depicts a single open-reading frame (ORF) and associated genetic elements of a picornavirus RNA genome that encodes a viral polyprotein in a single ORF.

During picornavirus proteolytic processing, a single polypeptide precursor, which may be translated from a single open reading frame of a picornavirus RNA genome, is cleaved into functional proteins by virally encoded proteases including wild type picornavirus 3C proteases. Typically, cleavage take place at different stages as shown in FIG. 1, forming multiple intermediate polypeptide precursors including P1, P2 and P3, which are further cleaved to form structural proteins VP1, VP2, VP3 and VP4, as well as non-structural proteins L, 2A, 2B, 2C, 3A, $3B_1$, $3B_2$, $3B_3$, 3C and 3D.

P1 is typically cleaved during assembly of a mature virus by a wild type picornavirus 3C protease to yield VP0 VP1 and VP3, which self-assemble to form a roughly spherical protein shell (capsid). Typically, auto-catalytic cleavage of VP0 into VP2 and VP4 occurs during encapsidation of the viral genome to produce a mature virus. The capsid generally serves to protect the genome while the virus is outside of cells and also allows it to bind and subsequently gain entry to cells through interaction with specific cell-surface receptors (e.g., certain integrins). The virus capsid may be composed of numerous copies, e.g., 60 copies, of each of VP1, VP2, VP3 and VP4.

The proteolytic activity of the modified picornavirus 3C protease encoded by an isolated polynucleotide of the present disclosure and/or the present modified picornavirus 3C proteases may be greater or less than that of a control 3C protease. In some embodiments, the proteolytic activity of the present modified picornavirus 3C protease exhibits 10, 20, 30, 40, 50, 60, 70, 80, 90, 100, 110, 120, 130, 140, 150 or 200% of the proteolytic activity of a control picornavirus 3C protease. This activity may be determined based on the relative ability of the modified picornavirus 3C protease to perform one or more cleavages of P1, such as those producing VP0, VP1 and VP3 viral proteins, or in some embodiments, VP1, VP2, VP3 and VP4. In one non-limiting example, the modified picornavirus 3C protease exhibits at least 90% of the ability to cleave P1 compared to that of a control picornavirus 3C protease, such as its closest natural counterpart.

In further embodiments, a modified picornavirus 3C protease encoded by an isolated polynucleotide of the present disclosure or a modified picornavirus 3C protease as disclosed herein has the ability to process at least 900 of the total amount of a picornavirus P1 polypeptide precursor expressed in a host cell, such as at least 95%, or such as at least 99%, or such as at least 99.90%, e.g., 99.9-100.0% in comparison to that of a control picornavirus 3C protease.

Typically and advantageously, the instant modified picornavirus 3C protease encoded by an isolated polynucleotide of the present disclosure and/or the modified picornavirus 3C protease described herein retains its ability to fully process and to cleave a picornavirus P1 polypeptide precursor into individual capsid proteins VP1, VP2 VP3 and VP4 or VP0, VP1 and VP3 to allow subsequent assembly of these cleaved viral capsid proteins into an empty picornavirus capsid in a host cell.

In some embodiments, a modified picornavirus 3C protease encoded by an isolated polynucleotide of the present disclosure and/or the modified picornavirus 3C protease described herein has the ability to process at least 900% of a total amount of a single picornavirus polyprotein translation product including P1, P2 and P3. In some embodiments, a modified picornavirus 3C protease encoded by an isolated polynucleotide of the present disclosure and/or the modified picornavirus 3C protease described herein has the ability to process at least 90% of a total amount of a picornavirus polypeptide precursor such as P2 (or 2ABC), P3 (or 3ABCD), P1 (or 1ABCD), 1ABC, 2BC, 3AB, and 3CD. See FIG. 1. A modified picornavirus 3C protease encoded by an isolated polynucleotide of the present disclosure and/or the modified picornavirus 3C protease described herein may be used to cleave or process native sites in wild type picornavirus proteins and/or the same or similar 3C cleavage sites in non-picornavirus proteins, such as proteins engineered to include picornavirus 3C cleavage sites. In some embodiments, the picornavirus polypeptide precursors does not include a picornavirus P1 polypeptide precursor.

In some embodiments, the modified picornavirus 3C protease encoded by an isolated polynucleotide of the present disclosure and/or the modified picornavirus 3C protease reduces or eliminates the toxicity of the expressed picornavirus 3C protease towards a host cell, compared to that of a control 3C protease.

For example, the growth rate of a host cell or the yield of at least one protein encoded and expressed in a transformed host cell will be increased by at least 1, 2, 3, 4, 5, 10, 20, 30, 40, 50, 60, 70, 80, 90, 100, 150, 200, 300% or more for a host cell in which the modified picornavirus 3C protease encoded by an isolated polynucleotide of the present disclosure is expressed and/or the modified picornavirus 3C protease described herein is introduced when compared to the growth rate or the at least one protein yield of a host cell expressing a control picornavirus 3C protease.

In some embodiments, modification of a picornavirus 3C protease may increase the expression output of a transgene expression cassette and/or a recombinant expression vector containing at least a mutant nucleotide sequence encoding a modified picornavirus 3C protease of the present disclosure and a nucleotide sequence encoding a picornavirus P1 polypeptide precursor. In some non-limiting embodiments, the transgene expression output is increased by up to 20 times, such as 2-20 times, such as 5-15 times, such as 10-15 times in comparison to that of a transgene expression cassette and/or a recombinant expression vector containing a nucleotide sequence encoding a control picornavirus 3C protease and a nucleotide sequence encoding a picornavirus P1 polypeptide precursor. When a host cell is transfected with such a transgene expression cassette and/or a recombinant expression vector, the increase in the transgene expression output would translate into an increase in the production of virus-like particles (VLPs) in a host cell.

In some embodiments, the transgene expression output is assessed by fusing a luminescent reporter gene to a transgene expression cassette, such as a *Gaussia* luciferase gene (GLuc) or a variant thereof including, but not limited to SGLuc and then measuring the number of relative light units (RLU) utilizing an integration time of 0.5 seconds on a luminometer. In some non-limiting embodiments, a recombinant expression vector containing a transgene expression cassette or a recombinant expression vector containing at least a mutant nucleotide sequence encoding a modified picornavirus 3C protease encoded by an isolated polynucleotide of the present disclosure and a nucleotide sequence encoding a picornavirus P1 polypeptide precursor has a transgene expression output in a host cell of $10^9$-$10^{10}$ RLU/0.5 s, typically $2\times10^9$ to $8\times10^{10}$ RLU/0.5 s, and more typically $4\times10^9$ to $3\times10^{10}$ RLU/0.5 s.

In yet other embodiments, the viability or passage stability of a host cell (the ability of the host cell to stably maintain and express from passage-to-passage a transgene) expressing the modified picornavirus 3C protease encoded by an isolated polynucleotide of the present disclosure may be increased by 10, 20, 30, 40, 50, 60, 70, 80, 90, 100, 150, 200% or more compared to an otherwise identical host cell expressing a control picornavirus 3C protease.

The modified picornavirus 3C protease encoded by an isolated polynucleotide of the present disclosure may exhibit less than 100, 90, 80, 70, 60, 50, 40, 30, 20 or 10% of the proteolytic activity of a control picornavirus 3C protease on one or more host cell proteins at one or more host protein target sites or on other co-expressed proteins, such as those encoded by a transgene, while retaining a significant ability to process one or more picornavirus polypeptide precursor, such as a picornavirus P1 precursor protein or one or more picornavirus polypeptide precursor excluding a picornavirus P1 precursor protein.

In some embodiments, the modified picornavirus 3C protease encoded by an isolated polynucleotide of the present disclosure exhibits less than 100, 90, 80, 70, 60, 50, 40, 30, 20 or 10%, such as no higher than 10%, proteolytic activity towards a host protein, including, but not limited to the eukaryotic translation initiation factor 4A1 (eIF4A1), histone H3, nuclear transcription factor kappa B essential modulator (NEMO), Src-associated substrate in mitosis of 68 kDa (SAM68) and eukaryotic translation initiation factor 4G (eIF4G). In some embodiments, the presence of the modified picornavirus 3C protease encoded by an isolated polynucleotide of the present disclosure exhibits less Golgi fragmentation and a reduced loss of microtubule system integrity of a host cell in comparison to an otherwise identical host cell expressing a control picornavirus 3C protease.

In some embodiments, a modified picornavirus 3C protease encoded by an isolated polynucleotide of the present disclosure will have decreased proteolytic activity toward the eIF4A1 eukaryotic initiation factor compared to an otherwise identical unmodified picornavirus 3C protease, i.e., a control picornavirus 3C protease. A modified picornavirus 3C protease encoded by an isolated polynucleotide of the present disclosure may degrade only 0.001, 0.01, 0.1, 1, 5, 10, 20, 30, 40, 50, 60, 70, 80, 90 or 95% of an eIF4A1 eukaryotic initiation factor compared to that of a control picornavirus 3C protease. In some embodiments, such decreased activity is no higher than 10% based on the total amount of eIF4A1 expressed in a host cell, such as no higher than 8%, such as no higher than 5%, such as no higher than 1%, and such as 0.001-1.0%.

A modified picornrnavirus 3C protease encoded by an isolated polynucleotide of the present disclosure may exhibit a loss of activity towards at least one of histone H3, nuclear transcription factor kappa B essential modulator (NEMO), Src-associated substrate in mitosis of 68 kDa (SAM68) and/or eukaryotic translation initiation factor 4G (eIF4G) in comparison to that of a control picornavirus 3C protease. The modified 3C protease of the present disclosure may degrade only 0.001, 0.01, 0.1, 1, 5, 10, 20, 30, 40, 50, 60, 70, 80, 90 or 95% of at least one of histone H3, nuclear transcription factor kappa B essential modulator (NEMO), Src-associated substrate in mitosis of 68 kDa (SAM68) and/or eukaryotic translation initiation factor 4G (eIF4G) compared to an otherwise identical unmodified picornavirus 3C protease, i.e. a control picornavirus 3C protease. In further embodiments, the ability of a modified picornavirus 3C protease to induce Golgi fragmentation and loss of microtubule system integrity of a host cell is reduced or eliminated by the one or more mutations of the present disclosure in comparison to that of a control picornavirus 3C protease.

Exemplary Picornavirus Modified 3C Proteases

In some embodiments, the modified picornavirus 3C protease encoded by the isolated polynucleotide described herein and the present modified picornavirus 3C protease, such as a modified Aphthovirus 3C protease, e.g., a modified FMDV 3C protease, is at least 90%, such as at least 95%, such as at least 99% identical to a wild type FMDV 3C protease selected from among SEQ ID NO: 2 (A Turkey 2006), SEQ ID NO: 4 (A24 Cruzeiro iso71), SEQ ID NO: 6 (Asia Lebanon 89, serotype Asia 1), SEQ ID NO: 8 (Asia1 Shamir), SEQ ID NO: 10 (C3 Indaial), SEQ ID NO: 12 (O1 PanAsia), SEQ ID NO: 14 (O1 Manisa isolate 87 strain, serotype O), SEQ ID NO: 16 SAT1-20 iso11), SEQ ID NO: 18 (SAT2 Egypt 2010), and SEQ ID NO: 20 (SAT3 ZIM/6/91).

In some embodiments, the modified picornavirus 3C protease encoded by the isolated polynucleotide described herein and the present modified picornavirus 3C protease, such as a modified Aphihovirus 3C protease, e.g. a modified Bovine rhinitis 3C protease, is at least 90%, such as at least 95%, such as at least 99% identical to a wild type Bovine rhinitis 3C protease selected from among SEQ ID NO: 422 (Bovine rhinitis A Sd-1) and SEQ ID NO: 434 (Bovine rhinitis B).

In some embodiments, the modified picornavirus 3C protease encoded by the isolated polynucleotide described herein and the present modified picornavirus 3C protease, such as a modified Aphthovirus 3C protease, e.g. a modified Equine rhinitis A 3C protease, is at least 90%, such as at least 95%, such as at least 99% identical to a wild type Equine rhinitis A 3C protease of SEQ ID NO: 444.

In some embodiments, the modified picornavirus 3C protease encoded by the isolated polynucleotide described herein and the present modified picornavirus 3C protease, such as a modified Enterovirus A 3C protease, is at least 90%, such as at least 95%, such as at least 99% identical to a wild type Enterovirus A 3C protease selected from among the wild type Human coxsackievirus A10 3C protease of SEQ ID NO: 478 and the wild type Human enterovirus A71 3C protease of SEQ ID NO: 526.

In some embodiments, the modified picornavirus 3C protease encoded by the isolated polynucleotide described herein and the present modified picornavirus 3C protease, such as a modified Enterovirus B 3C protease, is at least 90%, such as at least 95%, such as at least 99% identical to a wild type Enterovirus B 3C protease selected from among the wild type Human coxsackievirus B1 3C protease of SEQ ID NO: 494 and the wild type Human coxsackievirus B3 3C protease of SEQ ID NO: 510 (Human Coxsackievirus B3 Macocy).

In some embodiments, the modified picornavirus 3C protease encoded by the isolated polynucleotide described herein and the present modified picornavirus 3C protease, such as a modified Enterovirus C 3C protease, is at least 90%, such as at least 95%, such as at least 99% identical to a wild type Enterovirus C 3C protease selected from among the wild type Human coxsackievirus A1 3C protease of SEQ ID NO: 462, (Human Coxsackievirus A1 Tompkins) and a wild type Human poliovirus 3C protease selected from among SEQ ID NO: 552 (Human Poliovirus 2 Strain R93152), SEQ ID NO: 565 (Human Poliovirus 3 Isolate CHN5275/JX/CHN/2001) and SEQ ID NO: 580 (Human Poliovirus Mahoney).

In some embodiments, the modified picornavirus 3C protease encoded by the isolated polynucleotide described herein and the present modified picornavirus 3C protease, such as a modified Rhinovirus A 3C protease, is at least 90%, such as at least 95%, such as at least 99% identical to a wild type Rhinovirus A 3C protease selected from among a wild type Human rhinovirus A 3C protease of SEQ ID NO: 604 (Human rhinovirus A20, Strain VR1130), a wild type Human rhinovirus A 3C protease of SEQ ID NO: 618

(Human rhinovirus A89, Strain VR1199) and a wild type Human rhinovirus A 3C protease of SEQ ID NO: 620 (Human rhinovirus A2).

In some embodiments, the modified picornavirus 3C protease encoded by the isolated polynucleotide described herein and the present modified picornavirus 3C protease, such as a modified Rhinovirus B 3C protease, is at least 90%, such as at least 95%, such as at least 99% identical to the wild type Rhinovirus B 3C protease of SEQ ID NO: 594 (Human rhinovirus B14).

In some embodiments, the modified picornavirus 3C protease encoded by the isolated polynucleotide described herein and the present modified picornavirus 3C protease, such as a modified Hepatovirus 3C protease, is at least 90%, such as at least 95%, such as at least 99% identical to the wild type Hepatovirus 3C protease of SEQ ID NO: 538 (Human Hepatitis A Virus).

In some embodiments, the modified picornavirus 3C protease encoded by the isolated polynucleotide described herein and the present modified picornavirus 3C protease comprises a modified FMDV 3C protease selected from among SEQ ID NO: 22 (A Turkey 2006, D123P), SEQ ID NO: 24 (A24 Cruzeiro iso71, D123P), SEQ ID NO: 26 (Asia Lebanon 89, serotype Asia 1, D123P), SEQ ID NO: 28 (Asial Shamir, D123P), SEQ ID NO: 30 (C3 Indaial, D123P), SEQ ID NO: 32 (01 PanAsia, D123P), SEQ ID NO: 34 (01 Manisa isolate 87 strain, serotype O, D123P), SEQ ID NO: 36 (SAT1-20 iso11, D123P), SEQ ID NO: 38 (SAT2 Egypt 2010, D123P) and SEQ ID NO: 40 (SAT3 ZIM/6/91, D123P).

In some embodiments, the modified picornavirus 3C protease encoded by the isolated polynucleotide described herein and the present modified picornavirus 3C protease comprises a modified FMDV 3C protease selected from among SEQ ID NO: 42 (A Turkey 2006, G125P), SEQ ID NO: 44 (A24 Cruzeiro iso71, G125P), SEQ ID NO: 46 (Asia Lebanon 89, serotype Asia 1, G125P), SEQ ID NO: 48 (Asial Shamir, G125P), SEQ ID NO: 50 (C3 Indaial, G125P), SEQ ID NO: 52 (01 PanAsia, G125P), SEQ ID NO: 54 (01 Manisa isolate 87 strain, serotype O, G125P), SEQ ID NO: 56 (SAT1-20 iso11, G125P), SEQ ID NO: 58 (SAT2 Egypt 2010, G125P) and SEQ ID NO: 60 (SAT3 ZIM/6/91, G125P).

In some embodiments, the modified picornavirus 3C protease encoded by the isolated polynucleotide described herein and the present modified picornavirus 3C protease comprises a modified FMDV 3C protease selected from among SEQ ID NO: 62 (A Turkey 2006, I128P), SEQ ID NO: 64 (A24 Cruzeiro iso71, I128P), SEQ ID NO: 66 (Asia Lebanon 89, serotype Asia 1, G125P), SEQ ID NO: 68 (Asial Shamir, I128P), SEQ ID NO: 70 (C3 Indaial, I128P), SEQ ID NO: 72 (01 PanAsia, G125P), SEQ ID NO: 74 (01 Manisa isolate 87 strain, serotype O, I128P), SEQ ID NO: 76 (SAT1-20 iso11, I128P), SEQ ID NO: 78 (SAT2 Egypt 2010, I128P) and SEQ ID NO: 80 (SAT3 ZIM/6/91, I128P).

In some embodiments, the modified picornavirus 3C protease encoded by the isolated polynucleotide described herein and the present modified picornavirus 3C protease comprises a modified FMDV 3C protease selected from among SEQ ID NO: 82 (A Turkey 2006, I22P), SEQ ID NO: 84 (A24 Cruzeiro iso71, I22P), SEQ ID NO: 86 (Asia Lebanon 89, serotype Asia 1, I22P), SEQ ID NO: 88 (Asial Shamir, I22P), SEQ ID NO: 90 (C3 Indaial, I22P), SEQ ID NO: 92 (01 PanAsia, I22P), SEQ ID NO: 94 (01 Manisa isolate 87 strain, serotype O, I22P), SEQ ID NO: 96 (SAT1-20 iso11, I22P), SEQ ID NO: 98 (SAT2 Egypt 2010, I22P) and SEQ ID NO: 100 (SAT3 ZIM/6/91, I22P).

In some embodiments, the modified picornavirus 3C protease encoded by the isolated polynucleotide described herein and the present modified picornavirus 3C protease comprises a modified FMDV 3C protease selected from among SEQ ID NO: 102 (A Turkey 2006, I99P), SEQ ID NO: 104 (A24 Cruzeiro iso71, I99P), SEQ ID NO: 106 (Asia Lebanon 89, serotype Asia 1, I99P), SEQ ID NO: 108 (Asial Shamir, I99P), SEQ ID NO: 110 (C3 Indaial, I99P), SEQ ID NO: 112 (01 PanAsia, I99P), SEQ ID NO: 114 (01 Manisa isolate 87 strain, serotype O, I99P), SEQ ID NO: 116 (SAT2 Egypt 2010, I99P), SEQ ID NO: 178 (SAT1-20 iso11, I99P) and SEQ ID NO: 180 (SAT3 ZIM/6/91, I99P).

In some embodiments, the modified picornavirus 3C protease encoded by the isolated polynucleotide described herein and the present modified picornavirus 3C protease comprises a modified FMDV 3C protease selected from among SEQ ID NO: 138 (A Turkey 2006, L23P), SEQ ID NO: 140 (A24 Cruzeiro iso71, L23P), SEQ ID NO: 142 (Asia Lebanon 89, serotype Asia 1, L23P), SEQ ID NO: 144 (Asial Shamir, L23P), SEQ ID NO: 146 (C3 Indaial, L23P), SEQ ID NO: 148 (01 PanAsia, L23P), SEQ ID NO: 150 (O1 Manisa isolate 87 strain, serotype O, L23P), SEQ ID NO: 152 (SAT1-20 iso11, L23P), SEQ ID NO: 154 (SAT2 Egypt 2010, L23P) and SEQ ID NO: 156 (SAT3 ZIM/6/91, L23P).

In some embodiments, the modified picornavirus 3C protease encoded by the isolated polynucleotide described herein and the present modified picornavirus 3C protease comprises a modified FMDV 3C protease selected from among SEQ ID NO: 182 (A Turkey 2006, R126P), SEQ ID NO: 184 (A24 Cruzeiro iso71, R126P), SEQ ID NO: 186 (Asia Lebanon 89, serotype Asia 1, R126P), SEQ ID NO: 188 (Asial Shamir, R126P), SEQ ID NO: 190 (C3 Indaial, R126P), SEQ ID NO: 192 (01 PanAsia, R126P), SEQ ID NO: 194 (01 Manisa isolate 87 strain, serotype O, R126P), SEQ ID NO: 196 (SAT1-20 iso11, R126P), SEQ ID NO: 198 (SAT2 Egypt 2010, R126P) and SEQ ID NO: 200 (SAT3 ZIM/6/91, R126P).

In some embodiments, the modified picornavirus 3C protease encoded by the isolated polynucleotide described herein and the present modified picornavirus 3C protease comprises a modified FMDV 3C protease selected from among SEQ ID NO: 202 (A Turkey 2006, T100P), SEQ ID NO: 204 (A24 Cruzeiro iso71, T100P), SEQ ID NO: 206 (Asia Lebanon 89, serotype Asia 1, T100P), SEQ ID NO: 208 (Asial Shamir, T100P), SEQ ID NO: 210 (C3 Indaial. T100P), SEQ ID NO: 212 (01 PanAsia, T100P), SEQ ID NO: 214 (01 Manisa isolate 87 strain, serotype O, T100P), SEQ ID NO: 216 (SAT1-20 iso11, T100P), SEQ ID NO: 218 (SAT2 Egypt 2010, T100P) and SEQ ID NO: 220 (SAT3 ZIM/6/91, T100P).

In some embodiments, the modified picornavirus 3C protease encoded by the isolated polynucleotide described herein and the present modified picornavirus 3C protease comprises a modified FMDV 3C protease selected from among SEQ ID NO: 222 (A Turkey 2006, V124P), SEQ ID NO: 224 (A24 Cruzeiro iso71, V124P), SEQ ID NO: 226 (Asia Lebanon 89, serotype Asia 1, V124P), SEQ ID NO: 228 (Asial Shamir, V124P), SEQ ID NO: 230 (C3 Indaial, V124P), SEQ ID NO: 232 (01 PanAsia, V124P), SEQ ID NO: 234 (01 Manisa isolate 87 strain, serotype O, V124P), SEQ ID NO: 236 (SAT1-20 iso11, V124P), SEQ ID NO: 238 (SAT2 Egypt 2010, V124P) and SEQ ID NO: 240 (SAT3 ZIM/6/91, V124P).

In some embodiments, the modified picornavirus 3C protease encoded by the isolated polynucleotide described herein and the present modified picornavirus 3C protease comprises a modified FMDV 3C protease selected from among SEQ ID NO: 242 (A Turkey 2006, I22P/L127P), SEQ ID NO: 244 (A24 Cruzeiro iso71, I22P/L127P), SEQ ID NO: 246 (Asia Lebanon 89, serotype Asia 1, I22P/L127P), SEQ ID NO: 248 (Asial Shamir, I22P/L127P), SEQ ID NO: 250 (C3 Indaial, I122P/L127P), SEQ ID NO: 252 (01 PanAsia, I22P/L127P), SEQ ID NO: 254 (01 Manisa isolate 87 strain, serotype O, I22P/L127P), SEQ ID NO: 256 (SAT1-20 iso11, I22P/L127P), SEQ ID NO: 258 (SAT2 Egypt 2010, I22P/L127P) and SEQ ID NO: 260 (SAT3 ZIM/6/91, I22P/L127P).

In some embodiments, the modified picornavirus 3C protease encoded by the isolated polynucleotide described herein and the present modified picornavirus 3C protease comprises a modified FMDV 3C protease selected from among SEQ ID NO: 262 (A Turkey 2006, T100P/L127P), SEQ ID NO: 264 (A24 Cruzeiro iso71, T100P/L127P), SEQ ID NO: 266 (Asia Lebanon 89, serotype Asia 1, T100P/L127P), SEQ ID NO: 268 (Asial Shamir, T100P/L127P), SEQ ID NO: 270 (C3 Indaial, T100P/L127P), SEQ ID NO: 272 (01 PanAsia, T100P/L127P), SEQ ID NO: 274 (01 Manisa isolate 87 strain, serotype O, T100P/L127P), SEQ ID NO: 276 (SAT1-20 iso11, T100P/L127P), SEQ ID NO: 278 (SAT2 Egypt 2010, T100P/L127P) and SEQ ID NO: 280 (SAT3 ZIM/6/91, T100P/L127P).

In some embodiments, the modified picornavirus 3C protease encoded by the isolated polynucleotide described herein and the present modified picornavirus 3C protease comprises a modified FMDV 3C protease selected from among SEQ ID NO: 302 (A Turkey 2006, V124P/L127P), SEQ ID NO: 304 (A24 Cruzeiro iso71, V124P/L127P), SEQ ID NO: 306 (Asia Lebanon 89, serotype Asia 1, V124P/L127P), SEQ ID NO: 308 (Asial Shamir, V124P/L127P), SEQ ID NO: 310 (C3 Indaial, V124P/L127P), SEQ ID NO: 312 (01 PanAsia, V124P/L127P), SEQ ID NO: 314 (01 Manisa isolate 87 strain, serotype O, V124P/L127P), SEQ ID NO: 316 (SAT1-20 iso11, V124P/L127P), SEQ ID NO: 318 (SAT2 Egypt 2010, V124P/L127P) and SEQ ID NO: 320 (SAT3 ZIM/6/91, V124P/L127P).

In some embodiments, the modified picornavirus 3C protease encoded by the isolated polynucleotide described herein and the present modified picornavirus 3C protease comprises a modified FMDV 3C protease selected from among SEQ ID NO: 322 (A Turkey 2006, I22P/T100P/L127P), SEQ ID NO: 324 (A24 Cruzeiro iso71, I22P/T100P/L127P), SEQ ID NO: 326 (Asia Lebanon 89, serotype Asia 1, I22P/T100P/L127P), SEQ ID NO: 328 (Asial Shamir, I22P/T100P/L127P), SEQ ID NO: 330 (C3 Indaial, I22P/T100P/L127P), SEQ ID NO: 332 (01 PanAsia, I22P/T100P/L127P), SEQ ID NO: 334 (01 Manisa isolate 87 strain, serotype O, I22P/T100P/L127P), SEQ ID NO: 336 (SAT1-20 iso11, I22P/T100P/L127P), SEQ ID NO: 338 (SAT2 Egypt 2010, I22P/T100P/L127P) and SEQ ID NO: 340 (SAT3 ZIM/6/91, I22P/T100P/L127P).

In some embodiments, the modified picornavirus 3C protease encoded by the isolated polynucleotide described herein and the present modified picornavirus 3C protease comprises a modified FMDV 3C protease selected from among SEQ ID NO: 342 (A Turkey 2006, I22P/T100P/V124P), SEQ ID NO: 344 (A24 Cruzeiro iso71, I22P/T100P/V124P), SEQ ID NO: 346 (Asia Lebanon 89, serotype Asia 1, I22P/T100P/V124P), SEQ ID NO: 348 (Asial Shamir, I22P/T100P/V124P), SEQ ID NO: 350 (C3 Indaial, I22P/T100PN/V24P), SEQ ID NO: 352 (01 PanAsia, I22P/T100PN/V24P), SEQ ID NO: 354 (01 Manisa isolate 87 strain, serotype O, I22P/T100P/V124P), SEQ ID NO: 356 (SAT1-20 iso11, I22P/T100P/V124P), SEQ ID NO: 358 (SAT2 Egypt 2010, I22P/T100P/V124P) and SEQ ID NO: 360 (SAT3 ZIM/6/91, I22P/T100P/V124P).

In some embodiments, the modified picornavirus 3C protease encoded by the isolated polynucleotide described herein and the present modified picornavirus 3C protease comprises a modified Bovine rhinitis 3C protease selected from among SEQ ID NO: 412 (Bovine rhinitis A Sd-1, C23P), SEQ ID NO: 414 (Bovine rhinitis A Sd-1, F120P), SEQ ID NO: 416 (Bovine rhinitis A Sd-1, L123P), SEQ ID NO: 418 (Bovine rhinitis A Sd-1, T96P), SEQ ID NO: 420 (Bovine rhinitis A Sd-1, V22P), SEQ ID NO: 424 (Bovine rhinitis B, L124P), SEQ ID NO: 426 (Bovine rhinitis B R23P), SEQ ID NO: 428 (Bovine rhinitis B, T97P), SEQ ID NO: 430 (Bovine rhinitis B, V121) and SEQ ID NO: 432 (Bovine Rhinitis B, V22P).

In some embodiments, the modified picornavirus 3C protease encoded by the isolated polynucleotide described herein and the present modified picornavirus 3C protease comprises a modified Equine rhinitis A 3C protease selected from among SEQ ID NO: 436 (Equine rhinitis A, A125P), SEQ ID NO: 438 (Equine rhinitis A, C23P), SEQ ID NO: 440 (Equine rhinitis A, T127P), SEQ ID NO: 442 (Equine rhinitis A, V100P) and SEQ ID NO: 446 (Equine rhinitis A, Y22P).

In some embodiments, the modified picornavirus 3C protease encoded by the isolated polynucleotide described herein and the present modified picornavirus 3C protease comprises a modified Enterovirus A 3C protease selected from among SEQ ID NO: 464 (Human Coxsackievirus A10 Kowalik, L102P), SEQ ID NO: 466 (Human Coxsackievirus A10 Kowalik, (M109P), SEQ ID NO: 468 (Human Coxsackievirus A10 Kowalik, N105P), SEQ ID NO: 470 (Human Coxsackievirus A10 Kowalik, Q19P), SEQ ID NO: 472 (Human Coxsackievirus A10 Kowalik, T106P), SEQ ID NO: 474 (Human Coxsackievirus A10 Kowalik, T20P), SEQ ID NO: 476 (Human Coxsackievirus A10 Kowalik, T87P), SEQ ID NO: 512 (Human Enterovirus A71 Strain C4, I104P), SEQ ID NO: 514 (Human Enterovirus A71 Strain C4, M109P), SEQ ID NO: 516 (Human Enterovirus A71 Strain C4, N105P), SEQ ID NO: 518 (Human Enterovirus A71 Strain C4, Q19P), SEQ ID NO: 520 (Human Enterovirus A71 Strain C4, T106P), SEQ ID NO: 522 (Human Enterovirus A71 Strain C4, T20P) and SEQ ID NO: 524 (Human Enterovirus A71 Strain C4, T87P).

In some embodiments, the modified picornavirus 3C protease encoded by the isolated polynucleotide described herein and the present modified picornavirus 3C protease comprises a modified Enterovirus B 3C protease selected from SEQ ID NO: 480 (Human Coxsackievirus B1, F109P), SEQ ID NO: 482 (Human Coxsackievirus B1, K19P), SEQ ID NO: 484 (Human Coxsackievirus B1, L102P), SEQ ID NO: 486 (Human Coxsackievirus B1, N105P), SEQ ID NO: 488 (Human Coxsackievirus B1, R87P), SEQ ID NO: 490 (Human Coxsackievirus B1, T106P), SEQ ID NO: 492 (Human Coxsackievirus B1, T20P), SEQ ID NO: 496 (Human Coxsackievirus B3 Macocy (F109P), SEQ ID NO: 498 Human Coxsackievirus B3 Macocy, K19P), SEQ ID NO: 500 (Human Coxsackievirus B3 Macocy, L102P), SEQ ID NO: 502 (Human Coxsackievirus B3 Macocy, N105P), SEQ ID NO: 504 (Human Coxsackievirus B3 Macocy. R87P), SEQ ID NO: 506 (Human Coxsackievirus B3 Macocy, T106P) and SEQ ID NO: 508 (Human Coxsackievirus B3 Macocy, T20P).

In some embodiments, the modified picornavirus 3C protease encoded by the isolated polynucleotide described herein and the present modified picornavirus 3C protease comprises a modified Enterovirus C 3C protease selected from among SEQ ID NO: 448 (Human Coxsackievirus A1 Tompkins, F109P), SEQ ID NO: 450 (Human Coxsackievirus A1 Tompkins, L102P), SEQ ID NO: 452 (Human Coxsackievirus A1 Tompkins, N105P), SEQ ID NO: 454 (Human Coxsackievirus A1 Tompkins, R87P), SEQ ID NO: 456 (Human Coxsackievirus A1 Tompkins, T106P), SEQ ID NO: 458 (Human Coxsackievirus A1 Tompkins, T19P), SEQ ID NO: 460 (Human Coxsackievirus A1 Tompkins, T20P), SEQ ID NO: 540 (Human Poliovirus 2 Strain R93152, I103P), SEQ ID NO: 542 (Human Poliovirus 2 Strain R93152, L102P), SEQ ID NO: 544 (Human Poliovirus 2 Strain R93152, R87P), SEQ ID NO: 546 (Human Poliovirus 2 Strain R93152, T19P), SEQ ID NO: 548 (Human Poliovirus 2 Strain R93152, T20P), SEQ ID NO: 550 (Human Poliovirus 2 Strain R93152, V104P), SEQ ID NO: 554 (Human Poliovirus 3 Isolate CHN5275/JX/CHN/2001, I103P), SEQ ID NO: 556 (Human Poliovirus 3 Isolate CHN5275/JX/CHN/2001, L102P), SEQ ID NO: 558 (Human Poliovirus 3 Isolate CHN5275/JX/CHN/2001, R87P), SEQ ID NO: 560 (Human Poliovirus 3 Isolate CHN5275/JX/CHN/2001, T19P), SEQ ID NO: 562 (Human Poliovirus 3 Isolate CHN5275/JX/CHN/2001, T20P), SEQ ID NO: 564 (Human Poliovirus 3 Isolate CHN5275/JX/CHN/2001, V104P), SEQ ID NO: 568 (Human Poliovirus Mahoney, I103P), SEQ ID NO: 570 (Human Poliovirus Mahoney, L102P), 572 (Human Poliovirus Mahoney, R87P), SEQ ID NO: 574 (Human Poliovirus Mahoney, T19P), 576 (Human Poliovirus Mahoney, T20P) and SEQ ID NO: 578 (Human Poliovirus Mahoney, V104P).

In some embodiments, t the modified picornavirus 3C protease encoded by the isolated polynucleotide described herein and the present modified picornavirus 3C protease comprises a modified Rhinovirus A 3C protease selected from among SEQ ID NO: 596 (Human Rhinovirus A20, Strain VR1130 (K88P), SEQ ID NO:598 (Human Rhinovirus A20, Strain VR1130, R87P), SEQ ID NO: 600 (Human Rhinovirus A20, Strain VR1130, T19P), SEQ ID NO: 602 (Human Rhinovirus A20, Strain VR1130, T20P), SEQ ID NO: 606 (Human Rhinovirus A89, Strain VR1199, I114P), SEQ ID NO: 608 (Human Rhinovirus A89, Strain VR1199, K88P), SEQ ID NO: 610 (Human Rhinovirus A89, Strain VR1199, R87P), SEQ ID NO: 612 (Human Rhinovirus A89, Strain VR1199, T112P), SEQ ID NO: 614 (Human Rhinovirus A89, Strain VR1199, T19P), SEQ ID NO: 616 (Human Rhinovirus A89, Strain VR1199, T20P), SEQ ID NO: 622 (Human Rhinovirus A2, I114P), SEQ ID NO: 624 (Human Rhinovirus A2, Q108P), SEQ ID NO: 626 (Human Rhinovirus A2, R87P), SEQ ID NO: 628 (Human Rhinovirus A2, R88P), SEQ ID NO: 630 (Human Rhinovirus A2, T112P), SEQ ID NO: 632 (Human Rhinovirus A2, T19P) and SEQ ID NO: 634 (Human Rhinovirus A2, T20P).

In some embodiments, the modified picornavirus 3C protease encoded by the isolated polynucleotide described herein and the present modified picornavirus 3C protease comprises a modified Rhinovirus B 3C protease selected from among SEQ ID NO: 582 (Human rhinovirus B14, E114P), SEQ ID NO: 584 (Human rhinovirus B14, G88P), SEQ ID NO: 586 (Human rhinovirus B14, I1112P), SEQ ID NO: 588 (Human rhinovirus B14, R87P), SEQ ID NO: 590 (Human rhinovirus B14, T19P) and SEQ ID NO: 592 (Human rhinovirus B14, T20P).

In some embodiments, the modified picornavirus 3C protease encoded by the isolated polynucleotide described herein and the present modified picornavirus 3C protease comprises a modified Hepatovirus 3C protease selected from among SEQ ID NO: 654 (Human hepatitis A Virus, V18P), SEQ ID NO: 652 (Human hepatitis A Virus, G17P), SEQ ID NO: 528 (Human hepatitis A Virus, E20P), SEQ ID NO: 530 (Human hepatitis A Virus, G19P), SEQ ID NO: 532 (Human hepatitis A Virus, I130P), SEQ ID NO: 534 (Human hepatitis A Virus, M128P), SEQ ID NO: 536 (Human hepatitis A Virus, T100P).

Further Modifications, Provisos

Further modifications may be made to a polynucleotide sequence encoding a modified picornavirus 3C protease of the present disclosure and/or a modified picornavirus 3C protease as described herein. For example, prior to the transformation of a host cell, codon frequency of a polynucleotide sequence encoding a modified picornavirus 3C protease may be modified to optimize expression or stability of a nucleic acid encoding a modified picornavirus 3C protease. Software suitable for optimizing codon usage is known and may be used to optimize codon usage in nucleic acid encoding a modified picornavirus 3C protease, see Optimizer available at genomes._urv.cat/OPTIMIZER/ (last accessed Feb. 5, 2016). Codon usage frequencies for various organisms are known and are also incorporated by reference to the Codon Usage Database at www._kazusa.or.jp/codon/ (last accessed Feb. 5, 2016).

Not all amino acid codons are degenerate, for example, in the genetic code of most organisms, Met and Trp are encoded by single codons. However, for degenerate codons, frequency or average frequency of codon usage may be selected to range from 0% (no common degenerate codons) to 100% (same frequency of codon usage as host cell genome). This range includes all intermediate values include 0%, 10%, 20%, 30%, 400%, 50%, 60%, 70%, 80%, 90%, 95% and 100%. Similarly, G+C content of a nucleic acid encoding a modified picornavirus 3C protease may be matched, moved closer or moved away from that of the host cell by selection of a degenerate codon with more or fewer G or C nucleotides. G+C content of exogenous nucleic acids encoding a modified picornavirus 3C protease of the present disclosure may range within 1, 2, 3, 4, 5, 6, 7, 8, 9, 10, 20, 30, 40, 50% more or less than the average G+C content of the host cell.

Alternatively, codon usage may be modified to modulate or control the expression of a modified picornavirus 3C protease of the present disclosure and/or to attenuate the expression of host cell proteins required for host cell viability, growth, or robustness; see for example, Kew, et al., U.S. Pat. No. 8,846,051 hereby incorporated by reference in its entirety. In some embodiments, expression of a modified picornavirus 3C protease by a host cell may be limited or reduced by 5, 10, 20, 30, 40, 50, 60, 70, 80, 90, 95% or more compared to a maximum expression rate (e.g., where codon frequency is matched to the host cell).

In certain embodiments, it is desirable that an arginine residue at position 126 (R126) of a modified FMDV 3C protease encoded by an isolated polynucleotide of the present disclosure is not substituted. As a non-limiting example, a modified FMDV 3C protease provided herein does not include a substitution of R126 with an acidic amino acid, such as aspartic acid and glutamic acid. More particularly, the modified FMDV 3C protease does not include a substitution of R126 with a glutamic acid (i.e., R126E).

In certain embodiments, it is desirable that the leucine residue at position 42 (L42) of a modified FMDV 3C protease of a modified picornavirus encoded by an isolated polynucleotide of the present disclosure is substituted with histidine. The modified FMDV 3C protease may be derived or obtained from any serotype described herein. Exemplary modified FMDV 3C proteases encoded by the isolated polynucleotide of the present disclosure, which incorporate a histidine at position 42 are set forth in SEQ ID NOS: 158, 160, 162, 164, 166, 168, 170, 172, 174 and 176. SEQ ID NOS: 158, 160,162, 164, 166, 168, 170, 172, 174 and 176 are encoded, respectively, by SEQ ID NOS: 157, 159, 161, 163, 165, 167, 169, 171, 173 and 175.

In certain embodiments, it is desirable that the threonine residue at position 34 be substituted with alanine and a methionine at position 88 be substituted with leucine in a modified FMDV 3C protease encoded by an isolated polynucleotide of the present disclosure. The modified FMDV 3C protease may be derived or obtained from any serotype described herein. Exemplary modified FMDV 3C proteases encoded by the isolated polynucleotide of the present disclosure, which incorporate an alanine and a leucine at positions 34 and 88, respectively, are set forth in SEQ ID NOS: 282, 284, 286, 288, 290, 292, 294, 296, 298 and 300, which are encoded, respectively, by SEQ ID NOS: 281, 283, 285, 287, 289, 291, 293, 295, 297, and 299, respectively.

Transgene Expression Cassettes

Another aspect of the present disclosure is directed to an isolated polynucleotide comprising an isolated polynucleotide encoding a modified picornavirus 3C protease of the present disclosure. In some embodiments, the isolated polynucleotide comprising the isolated polynucleotide encoding the modified picornavirus 3C protease is a transgene expression cassette. In some embodiments, the transgene expression cassette further includes a nucleotide sequence encoding a picornavirus P1 polypeptide precursor. In some embodiments, the nucleotide sequence encoding the P1 polypeptide precursor is obtained or derived from any of the A, O, C, Asia 1, SAT1, SAT2 and SAT3 serotypes, as well as the subtypes, topotypes and strains within these seven serotypes or other picornavirus isolates or variants.

In some embodiments, the nucleotide sequence encodes a picornavirus P1 polypeptide precursor, such as an FMDV P1 polypeptide precursor, is selected from among SEQ ID NO: 362 (A Turkey 2006, wild type), SEQ ID NO: 365 (A24 Cruzeiro iso71, wild type), SEQ ID NO: 368 (Asial Shamir, wild type), SEQ ID NO: 371 (C3 Indaial, wild type), SEQ ID NO: 374 (01 Manisa isolate 87 strain, serotype O, wild type), SEQ ID NO: 377 (01 PanAsia, wild type), SEQ ID NO: 380 (SAT1-20 iso11, wild type), SEQ ID NO: 383 (SAT2 Egypt 2010, wild type), and SEQ ID NO: 386 (SAT3 ZIM/6/91, wild type).

The amino acid sequences of the P1 polypeptides encoded by the nucleotide sequences immediately above include those described by SEQ ID NOS: 363, 366, 369, 372, 375, 378, 381, 384 and 387, respectively. A P1 polypeptide may be modified, for example, by deletion, substitution or insertion of 1, 2, 3, 4, 5, 6, 7, 8, 9, 10, 15, 20, or more amino acid residues provided that the P1 polypeptide retains or contains one or more epitopes, including both humoral and cellular epitopes, recognized by an animal's immune system (e.g., an FMDV mammalian host). Native P1 polypeptides are at least 62-10⁰%% homologous. In some embodiments, a P1 polypeptide according to the present disclosure may be described as one capable of processing and assembling into a picornavirus capsid, such as an FMDV capsid. A P1 polypeptide may also be structurally described as having 60, 70, 80, 90, 95, 96, 97, 98, 99, or 100% (or any intermediate value) identical or similar to any of the P1 polypeptides disclosed herein or to other known P1 polypeptides.

In other embodiments, the polynucleotide sequence encoding a picornavirus P1 polypeptide precursor, such as an FMDV P1 polypeptide precursor, is modified to remove internal restriction sites. Such FMDV P1 polypeptide precursors may be selected from among: SEQ ID NO: 361 (A Turkey 2006, restriction sites removed), SEQ ID NO: 364 (A24 Cruzeiro iso71, restriction sites removed), SEQ ID NO: 367 (Asial Shamir, restriction sites removed), SEQ ID NO: 370 (C3 Indaial, restriction sites removed), SEQ ID NO: 373 (01 Manisa isolate 87 strain, serotype O, restriction sites removed), SEQ ID NO: 376 (01 PanAsia, restriction sites removed), SEQ ID NO: 379 (SAT1-20 iso11, restriction sites removed), SEQ ID NO: 381 (SAT2 Egypt 2010, restriction sites removed), and SEQ ID NO: 385 (SAT3 ZIM/6/91, restriction sites removed).

In another embodiment of the present disclosure, mutagenesis strategies and techniques as described herein may be applied to introduce one or more mutations to the nucleotide sequence encoding the polypeptide P1 precursor to enhance the stability of the final assembled capsid product. Among the mutations that can be introduced include, but are not limited to, nonsense mutations that effectively eliminate restriction enzyme recognition sites to better facilitate cloning and sub-cloning yet maintain the same translated protein product by not causing any amino acid substitution. These mutations enhance the cloning in and cloning out of the P1 polypeptide precursor into a transgene expression cassette to swap different P1 polypeptide precursors from different, e.g., FMDV serotypes, to promptly respond to the needs of individual outbreaks.

In a further embodiment, the transgene expression cassette of the present disclosure further includes restriction enzyme recognition sites or sequences at each of the N-terminus and C-terminus of the expression cassette for cloning into an expression vector. Examples of these restriction enzyme recognition sites include but are not limited to recognition sequences for EcoRI, EcoRII, BamHI, HindIII, TaqI, NotI, HinFI, Sau3AI, PvuII, SmaI, NheI, HaeIII, HgaI, AluI, EcoRV, KpnI, PstI, SacI, SpeI, StuI, SphI, XbaI, SalI, ScaI, XcmI, BsiWI, XhoI, BstEII, PflMI, AccI, SacII, PpuMI, AgeI, NcoI, BstXI, MluI and AatI. Such a transgene construct may be cloned into a vector or polynucleotide construct and transfected into a host cell.

In some embodiments, the transgene expression cassette described in accordance with embodiments described herein does not encode a complete picornavirus genome and therefore cannot cause an accidental outbreak, for example, a foot-and-mouth disease outbreak, during manufacture, or administration of a vaccine containing the transgene expression cassette.

Furthermore, the transgene expression cassette, typically, only encodes one picornavirus non-structural protein, e.g., FMDV non-structural protein, such as a modified FMDV 3C protease encoded by an isolated polynucleotide of the present disclosure. Typically, animals treated with a vaccine containing the transgene expression cassette will not produce antibodies to other picornaviral, such as an Enterovirus, non-structural proteins that are expressed during a natural picornavirus infection. For example, if the transgene expression cassette contains a mutant nucleotide sequence encoding a modified FMDV 3C protease encoded by an isolated polynucleotide of the present disclosure, it will only produce antibodies for the modified FMDV 3C protease and not antibodies for other non-structural proteins, such as 2B, 2C, 3B, 3D, etc. See FIG. 1. The difference in antibody profiles produced after natural infection compared to vaccination with the transgene expression cassette confers the ability to differentiate infected animals from vaccinated animals and vice versa.

In some embodiments, the transgene expression cassette according to the instant disclosure can be constructed as a single open reading frame. The nucleotide sequence encoding the P1 polypeptide precursor may be positioned 5' or 3' to the nucleotide sequence encoding a modified picornavirus 3C protease, such as a modified FMDV 3C protease.

In certain embodiments, the transgene expression cassette further includes a translational regulatory element that is located between the nucleotide sequence encoding a P1 polypeptide precursor and the mutant nucleotide sequence encoding a modified picornavirus 3C protease, such as a modified FMDV 3C protease, to advantageously allow for individual, equimolar expression of the two proteins in a single open reading frame translation.

In some embodiments, the translational regulatory element is a translational interrupter sequence of 5 to 50 amino acid residues long, typically 15 to 40 residues, more typically 25 to 35 residues. In further embodiments, the translational interrupter sequence can contain portions of one or more modified picornavirus 3C protease(s) non-structural proteins (e.g., 1A, 1B, 1C, 1D, 2A, 2B, 2C, 3A, 3B, 3C, 3D). In some embodiments, the translational interrupter sequence is formed by incorporating an 11-amino acid sequence of the C-terminus of the 1D FMDV protein into the 18-amino acid FMDV 2A protein and a proline residue to the C-terminus of an FMDV 2A protein.

In some embodiments, the transgene expression cassette further includes a nucleotide sequence for initiation of translation in eukaryotes, such as a Kozak consensus sequence. In some embodiments, the nucleotide sequence encoding the P1 polypeptide precursor is positioned 5' to the mutant nucleotide sequence encoding a modified picornavirus 3C protease, such as a modified FMDV 3C protease, and the eukaryotic translation initiation sequence is positioned upstream or 5' to the nucleotide sequence encoding the P polypeptide precursor. In an alternative embodiment, the mutant nucleotide sequence encoding a modified picornavirus 3C protease, such as a modified FMDV 3C protease, is positioned 5' to a nucleotide sequence encoding the P1 polypeptide precursor, and the eukaryotic translation initiation sequence is positioned upstream or 5' to the mutant nucleotide sequence encoding a modified picornavirus 3C protease, such as a modified FMDV 3C protease.

In further embodiments, the transgene expression cassette includes a promoter. Like the eukaryotic translation initiation sequence in certain embodiments, the promoter is positioned upstream or 5' to the nucleotide sequence encoding the P1 polypeptide precursor or the mutant nucleotide sequence encoding a mutant FMDV 3C protease, depending on the arrangement of the two nucleotide sequences encoding the P1 polypeptide precursor and a modified picornavirus 3C protease, such as a modified FMDV 3C protease. In certain embodiments, strong and constitutive promoters, including but not limited to SV40, CMV, UBC, EFIA, PGK, and CAG, can be advantageously incorporated into the transgene expression cassette of the present disclosure for prolonged high levels of transgene expression in mammalian hosts to induce a strong immune response. A stop codon sequence (e.g., TAA, TGA, or TAG) may optionally be added to the end of the transgene expression cassette of the present disclosure to ensure cessation of mRNA translation.

Vectors

Another aspect of the present disclosure is directed to vectors containing the transgene expression cassette as described herein. Typically, the transgene expression cassette is cloned into a mammalian expression vector system. In some embodiments, the transgene expression cassette is cloned into a pSNAP vector (New England Biolabs). Examples of pSNAP vectors comprising isolated polynucleotides encoding the modified 3C proteases of the present disclosure are set forth in SEQ ID NOS: 406-408 and 410. In further embodiments, modifications to the pSNAP vector include, but are not limited to, decreasing the overall vector size and/or removal of one or more restriction enzyme recognition sequences at the multiple cloning site.

In other embodiments, the vector used for transferring the transgene expression cassette is a minicircle DNA vector. Typically, a minicircle DNA vector is a minicircle carrying a transgene expression cassette and does not contain an empty vector without an insert.

The use of a minicircle DNA vector to carry and transfer a transgene expression cassette allows mammalian cells to be transfected (e.g., directly) without utilizing an intermediate eukaryotic host system (e.g., insect cell line production system). Directly transfecting a mammalian cell with a minicircle DNA vector carrying a transgene expression cassette can eliminate the costs and labor associated with maintaining large volumes of intermediate host cell cultures in production facilities and harvesting empty capsids or virus-like particle (VLPs) produced by intermediate host cells.

Furthermore, minicircle vectors are typically smaller than standard plasmid vectors and lack extraneous bacterial sequences. In some embodiments, these features enhance transfection of cells and enable an extended duration of transgene expression within the mammalian host cell. For example, a minicircle vector is smaller than a standard vector as it lacks extraneous bacterial sequences found on plasmids. Differences in size between plasmid vectors and minicircle vectors can be attributed to the lack of extraneous bacterial sequences, inclusion of an insubstantial amount of extraneous bacterial sequences in comparison to the overall size of the vector, such as appreciably smaller in comparison to the plasmid, and variations thereof.

Methods of producing minicircle vectors that are capable of inducing production of picornavirus virus-like particles in mammalian host cells typically include a two-step procedure. Firstly, a full-size parental plasmid containing bacterial sequences and a transgene is produced in, e.g., *Escherichia coli*. While the parental plasmid is still inside the *E. coli* host, the expression of a site-specific recombinase is induced and the prokaryotic or bacterial bone is excised by the enzyme at the recombinase recognition sites. Non-limiting examples of site-specific recombinases include Tyr- and Ser-recombinases such as Cre recombinase, Flp recombinase, ParA resolvase and PhiC31 integrase. An example of suitable materials, techniques, approaches, and methods are described in U.S. Pat. No. 8,236,548 which is hereby incorporated by reference in its entirety. Further description may be found in Kay et al., A Robust System for Production of Minicircle DNA Vectors, Nature Biotechnology, 28 1287-1289 (2010) which is hereby incorporated by reference in its entirety.

Transformed Host Cells

Another aspect of the present disclosure is directed to cells that are transformed or transfected with a vector carrying a transgene expression cassette expressing at least a picornavirus P1 polypeptide precursor and a modified picornavirus 3C protease, such as an FMDV 3 C protease, that is capable of fully processing a picornavirus P1 polypeptide precursor, such as an FMDV P1 polypeptide precursor, into individual picornavirus capsid proteins, such as FMDV capsid proteins, of VP1, VP2, VP3 and VP4 or VP0, VP1 and VP3, without reduced toxicity to the transformed or transfected host cell in comparison to a host cell transformed with a control 3C protease and at least a picornavirus P1 polypeptide precursor. The host cells may be prokaryotic, such as bacterial cells, or eukaryotic. Typically, the host cells are eukaryotic, such as but not limited to, animal cells (particularly mammalian cells), such as a human embryonic kidney cell line (HEK-293) or a continuous porcine cell line LF-BK αV/β6, plant cells and yeast cells. Specific suitable host cells are described herein including those under the heading "Summary."

The host cells may be transformed using any conventional transformation techniques known to an ordinary artisan and as described herein. The host cells of the present disclosure may be grown under controlled conditions, generally outside of their natural environment, such as in a cell culture, prior to and/or post-transfection with the present transgene cassettes and/or recombinant vectors. In other embodiments, the host cells are grown inside of their natural environment, for example, as part of an organism.

Compositions

Other aspects of the present disclosure are directed to compositions comprising an isolated polynucleotide encoding a modified picornavirus 3C protease, a transgene expression cassette and/or a recombinant vector of the present disclosure and a pharmaceutically acceptable excipient, adjuvant, buffer or solution that is suitable for proteolysis by the present modified picornavirus 3C protease.

In some embodiments, the compositions of the present disclosure are immunogenic compositions, such as vaccines, typically DNA vaccines. As used herein, the term "immunogen" or "immunogenic" refers to any substrate that elicits an immune response in a host, e.g., an antibody response. The immunogenic compositions disclosed herein may or may not be immunoprotective or therapeutic. Accordingly, the term "immunogenic" is not intended to be limited to vaccines.

The term "elicit an immune response" refers to the stimulation of immune cells in vivo in response to a stimulus, such as an antigen. The immune response may include either or both of a cellular immune response, e.g., T cell and macrophage stimulation, and a humoral immune response, e.g., B cell and complement stimulation and antibody production. An immune response may be measured using techniques well-known in the art, including, e.g., antibody immunoassays, proliferation assays, and others.

In some embodiments, the immunogenic composition described herein may be used to obtain an antibody composition, which may then be administered to a subject to provide temporary immunity, i.e., artificially acquired passive immunity. Methods for preparing and administering such antibody compositions are known in the art and are described, for example, in U.S. Pat. No. 4,748,018, which is herein incorporated by reference in its entirety.

In some embodiments, the immunogenic composition of the present disclosure is a vaccine. The term "vaccine" as used herein refers to a composition comprising an antigen, which is useful to establish immunity to a virus in the subject. Vaccines may be prophylactic or therapeutic. For example, a vaccine may prevent, ameliorate, palliate, or eliminate the effects of a virus on a subject.

In some embodiments, the immunogenic compositions of the present disclosure can include an immunogenic amount of one or more vectors carrying a transgene expression cassette expressing at least a picornavirus P1 polypeptide precursor, such as an FMDV P1 polypeptide precursor, and a modified picornavirus 3C protease, such as a modified FMDV 3C protease, which is capable of fully processing the picornavirus P1 polypeptide precursor into individual picornavirus capsid proteins of VP1, VP2, VP3 and VP4 or VP0, VP1 and VP3 with reduced toxicity to the transformed or transfected host cell in comparison to a host cell that has been transformed or transfected with a control picornavirus 3C protease and at least a picornavirus P1 polypeptide precursor. An "immunogenic amount" is an amount capable of eliciting an immune response against a picornavirus, e.g., FMDV.

In one or more embodiments, the compositions, immunogenic compositions such as vaccines of the present disclosure may be formulated by any well-known method. The compositions can be prepared, for example, as injectables (e.g. subcutaneous, intradermal and intramuscular injection, jet injections), formulations for oral administration, intranasal administration (e.g. aerosol inhalation or instillation), topical administration to the eye, electroporation, gene gun, transfection, liposome-mediated delivery or combinations thereof, either as liquid solutions or suspensions. Solid forms suitable for solution in, or suspension in, liquid prior to injection or other administration may also be prepared. The preparation may also be emulsified or encapsulated in liposomes.

In one or more embodiments, the vaccines of the present disclosure may be formulated as multivalent or polyvalent vaccines containing immunogenic compositions that stimulate an immune response towards two or more different strains of the same species or of different species. In additional embodiments, the multivalent vaccines of the present disclosure contain at least one picornavirus capsid that is formed from VLPs processed from a P1 precursor using a modified picornavirus 3C protease, or 3CD fusion, of the present disclosure or a recombinant vector of the present disclosure. In yet further embodiments, the multivalent vaccines may include other immunogenic compositions, including, but not limited to full microbes that are either live, killed, attenuated or inactivated; toxoids thereof, subunits thereof, VLPs thereof; conjugates thereof; or nucleic acids thereof.

In one or more embodiments, the active immunogenic ingredients, e.g., a vector comprising a polynucleotide encoding a modified 3C protease, or 3CD fusion, and a P1 precursor polypeptide are mixed with adjuvants, salts, carriers, excipients or diluents, which are pharmaceutically acceptable and compatible with the active ingredient.

In some embodiments, adjuvants may be added to the present immunogenic compositions, e.g., vaccines, to modify the immune response by boosting it such as to give a higher amount of antibodies and a longer-lasting protection, thus minimizing the amount of injected foreign material. Adjuvants may also be used to enhance the efficacy of vaccines by helping to subvert the immune response to particular cell types of an immune system, for example by activating the T cells instead of antibody-secreting B cells. Example of adjuvants include, but are not limited to, aqueous-based aluminum hydroxide gel-saponin, the oil-based Montanide ISA 206, other aluminum-based adjuvants, incomplete Freunds adjuvant (IFA), and paraffin oil.

In a further embodiment, pharmaceutically acceptable salts, include but are not limited to, the acid addition salts (formed with free amino groups of the peptide) which are formed with inorganic acids (e.g., hydrochloric acid or phosphoric acids) and organic acids (e.g., acetic, oxalic, tartaric, or maleic acid). Salts formed with the free carboxyl groups may also be derived from inorganic bases (e.g., sodium, potassium, ammonium, calcium, or ferric hydroxides), and organic bases (e.g., isopropylamine, trimethylamine, 2-ethylamino-ethanol, histidine, and procaine).

In a further embodiment, example carriers include, but are not limited to, liquid carriers (e.g., water, saline, culture medium, saline, aqueous dextrose, aqueous glycols) and solid carriers (e.g., carbohydrates such as starch, glucose, lactose, sucrose, dextrans; anti-oxidants such as ascorbic acid and glutathione, hydrolyzed proteins).

In a further embodiment, suitable excipients include but are not limited to water, saline, dextrose, glycerol, ethanol, or the like and combinations thereof.

In a further embodiment, example diluents include, but are not limited to, water, physiological saline solution, human serum albumin, oils, polyethylene glycols, glycerin, propylene glycol or other synthetic solvents, antibacterial agents such as benzyl alcohol, antioxidants such as ascorbic acid or sodium bisulfite, chelating agents, such as ethylene diamine-tetra-acetic acid, buffers such as acetates, citrates or phosphates and agents for adjusting osmolarity, such as sodium chloride or dextrose.

In a further embodiment, the vaccines may contain minor amounts of auxiliary substances such as wetting or emulsifying agents, pH buffering agents, and/or other agents, which enhance the effectiveness of the vaccine. Examples of agents which may be effective include, but are not limited to: aluminum hydroxide; N-acetyl-muramyl-L-threonyl-D-isoglutamine (thr-MDP): N-acetyl-nor-muramyl-L-alanyl-D-isoglutamine (CGP 11637, referred to as nor-MDP); N-acetyl muramyl-L-alanyl-D-isoglutaminyl-L-alanine-2-(1'-2'-dipalmitoyl-sn-glycero-3-hydroxyphosphoryloxy)-ethyl amine (CGP 19835A, referred to as MTP-PE); and RIBI, which contains three components extracted from bacteria: monophosphoryl lipid A, trehalose dimycolate and cell wall skeleton (MPL+TDM+CWS) in a 2% squalene/Tween 80 emulsion. The effectiveness of the auxiliary substances may be determined by measuring the amount of antibodies (especially IgG, IgM or 19A) directed against the immunogen resulting from administration of the immunogen in vaccines which comprise the adjuvant in question. In a further embodiment, additional formulations and modes of administration may also be used.

In one or more embodiments, the picornavirus vaccines in accordance with the present disclosure, such as the FMDV vaccines, are marker vaccines or DIVA (Differentiating Infected from Vaccinated Animals), which induce immune responses that differ from those from natural infection. These differences are reflected in antibody profiles, and can be detected by diagnostic tests and assays such as enzyme linked immunosorbent assays (ELISAs) containing the same compositions used in the vaccine formulations. The DIVA strategy is useful in eradication scenarios wherein emergency vaccination using DIVA picornaviral vaccines, such as FMDV vaccines, could be an effective control tool for, e.g., picornaviral outbreaks, such as FMDV outbreaks, in densely populated livestock areas. DIVA vaccination can limit the number of culled animals in the process of a picornaviral eradication, such as an FMDV eradication, thereby enhancing public acceptance for disease control measures and limiting economic losses.

The efficacy of a picornavirus DNA vaccine may be determined by the rate of reduction in the incidence of a picornavirus among a population of subjects that have been vaccinated compared to the incidence in a population of unvaccinated subjects, over a duration of 12 months. Vaccine efficacy can be measured using the following formula:

$$VE = [(ARU-ARV)/ARU] \times 100\%$$

where "VE" is vaccine efficacy, "ARU" is an attack rate in an unvaccinated population and "ARV" is an attack rate in the vaccinated population In some embodiments, a picornavirus DNA vaccine, such as an FMDV vaccine, comprising a minicircle DNA vector in accordance with the present disclosure exhibits VE values of between 50-95%, approximately 50%, greater than 50%, 50%, approximately 75%, approximately 75%, greater than 75%, approximately 90%, greater than 90%, 95%, approximately 95%, or greater than 95%.

In certain embodiments, the compositions of the present disclosure, including the immunogenic compositions and vaccines, comprise an immunogenic amount of one or more picornavirus VLPs isolated and purified from a host cell culture, fragment(s) thereof, or subunit(s) thereof. In some embodiments, the VLPs are obtained using the modified 3C proteases as herein provided. In other embodiments, the vaccines can include one or more picornavirus capsid proteins and/or portions thereof, in combination with adjuvant molecules and portions thereof on the surfaces of the picornavirus VLPs, optionally further include another protein or other immunogen, such as one or more additional picornavirus viral components naturally associated with viral particles or an epitopic peptide derived therefrom.

Methods

Another aspect of the present disclosure is directed to protecting a mammalian subject against one or more strains of a picornavirus, such as FMDV, by administering to the mammalian subject a genetically engineered DNA (e.g., transgene expression cassette+expression vector) to produce an immune response through assembly of picornavirus VLPs, such as FMDV VLPs, in situ in the mammalian subjects. Suitable mammalian subjects may include any mammalian subject including humans, primates and/or cloven-hoofed animals including domestic and wild bovids such as bison, African buffalo, antelopes, impala, gazelles, sheep, goats and domestic cattle.

There are a number of advantages associated with DNA vaccine platforms, in comparison to traditional whole-pathogen vaccines and protein-based vaccines. For example, DNA vaccines do not contain an actual infectious agent, whether dead or alive. DNA vaccines can also be easily lyophilized for long-term storage and transportation and do not require any cold chain delivery.

Additionally, the DNA vector of a DNA vaccine can be produced and modified more quickly and more easily in comparison to a traditional vaccine preparation. This allows a more rapid response to specifically engineer DNA vaccines tailored to individual picornavirus outbreaks, such as FMDV outbreaks, including, but not limited to a DNA vaccine matching a specific picornavirus, such as a specific FMDV outbreak that is due to a particular strain or serotype. In some embodiments, using a minicircle DNA vector to carry and transfer the transgene expression cassette eliminates the use of an intermediate eukaryotic host system and the associated costs and labor, including modification of an intermediate host system during an outbreak, such as during the onset of an FMDV outbreak.

In one or more embodiments, the picornavirus vaccines, e.g., an FMDV vaccine, are administered prophylactically (e.g., to prevent or ameliorate the effects of a future infection), therapeutically (e.g., to treat or to empower the immune system of an infected organism) or both, in a manner compatible with a dosage formulation, and in such an amount and manner as will be prophylactically and/or therapeutically effective. The quantity to be administered for a DNA picornavirus vaccine as described herein is generally in the range of 1-1000 µg, typically 5-500 µg, more typically 50-550 µg, even more typically 100-200 µg of pre-assembled picornavirus VLPs per dose and/or adjuvant molecule per dose, depending on the subject to be treated, the capacity of the host immune system to synthesize antibodies, and the degree of protection desired. Precise amounts of the active ingredient required to be administered may depend on the judgment of the veterinarian or physician or may be peculiar to each individual subject, but such a determination is within the skill of such a practitioner.

The present immunogenic composition, e.g., vaccine, may be given in a single dose; two dose schedule, for example two to eight weeks apart; or a multiple dose schedule. A multiple dose schedule is one in which a primary course of vaccination may include 1 to 10 or more separate doses, followed by other doses administered at subsequent time intervals as required to maintain and/or reinforce the immune response (e.g., at 1 to 4 10 months for a second dose, and if needed, a subsequent dose(s) after several months).

Another aspect of the present disclosure is directed to a method of preparing picornavirus virus-like particles (VLPs), e.g., FMDV virus-like particles, which may be incorporated into the present compositions, e.g., the immunogenic compositions, such as the vaccine compositions described herein. In certain embodiments of the present disclosure, picornavirus VLPs, such as FMDV VLPs, are produced after contacting a picornavirus P1 polypeptide precursor with a modified picornavirus 3C protease, or 3CD fusion, encoded by the isolated polynucleotide of the present disclosure.

In some embodiments, a picornavirus P1 polypeptide precursor and a modified picornavirus 3C protease, or 3CD fusion, of the present disclosure are co-expressed in vivo inside a host cell that is transformed with a recombinant vector carrying a transgene expression cassette containing at least a mutant nucleotide sequence encoding a modified picornavirus 3C protease, or 3CD fusion, as described herein and a picornavirus P1 polypeptide precursor. The expressed picornavirus P1 polypeptide precursor may then be fully processed and cleaved by the expressed modified picornavirus 3C protease, or 3CD fusion, of the present disclosure into individual picornavirus capsid proteins of VP1, VP2, VP3 and VP4 or VP0, VP1 or VP3 and wherein these capsid proteins self-assemble to form empty picornavirus capsids. Picornavirus VLPs may assemble to form one or more picornavirus capsids, which may be isolated and purified from their host cells.

In other embodiments, picornavirus VLP production occurs in vitro. In these embodiments, VLPs are produced, e.g., in a test tube with appropriate solutions, buffers and/or cultural medium, or in a petri dish. The picornavirus VLPs produced in vitro may then be isolated and purified from the in vitro environment.

EXAMPLES

Example 1. Materials and Methods

1A. Isolation of pJJP Mutant Constructs

In order to assess the effects of modified FMDV 3C proteases on transgene expression, polynucleotide constructs were first synthesized into a pJJP plasmid (GenScript Inc., Piscataway, N.J.) containing a sequence encoding the P1-2A polypeptide from FMDV O1 Manisa iso87 (Accession: AY593823), the FMDV Asial Shamir 3C (Accession: AY593800), and the Δ1D2A-SGLuc (Δ1M) secreted biomarker. See Puckette et al., BMC Biotechnol., 2017, 17:52 for a description of 2A translational interrupter chimeras as reporters for transgene expression, which is herein incorporated by reference in its entirety. Select restriction cut sites were removed using silent mutations to facilitate easier cloning. The polynucleotide constructs were transformed into New England Biolabs (NEB) 5-Alpha competent E. coli (New England Biolabs Inc., Ipswitch, Mass.) according to the manufacturer's instructions for plasmid propagation. Cultures were grown at 37° C. overnight at 250 rotations per minute (rpm) in terrific broth with 100 micrograms per milliliter (μg/mL) carbenicillin. Plasmids were isolated using the QIAGEN® Plasmid Maxi kit (Qiagen Inc. Valencia Calif.).

1B. Random Mutagenesis of 3C Protease

Random mutagenesis of FMDV 3C protease was performed utilizing a Diversify PCR Random Mutagenesis Kit (Takara Holdings Inc., Shimogyo-ku, Kyoto, Japan) according to the manufacturer's recommendation to generate two mutations per 1000 bp. The template utilized was a synthesized wild-type FMDV Asial Shamir 3C (Accession: AY593800) in pUC57kan (GenScript Inc.) while primers utilized for the amplification were Nde-3C-F2 (CATATGAGTGGTGCCCCACCGAC, SEQ ID NO: 641) and Rand-XhoXba-R (CCGATTCTAGACTCGAGTTA, SEQ ID NO: 642). PCR cleanup was performed using a QIAQUICK® PCR Purification kit (Qiagen Inc.), and PCR product digested by restriction enzymes NdeI and XhoI (New England Biolabs Inc.), as suggested by manufacturer. Digested PCR product was cloned into a pSNAP-tag (T7)-2 vector (New England Biolabs Inc.), which had been similarly processed, using T7 ligase (Roche Holding AG Basel, Switzerland) as per manufacturer's suggestions.

1C. Bacterial Plating and Expression

Transformation of T7 Express Competent E. coli (New England Biolabs Inc.) was performed as suggested by the manufacturer. Prior to plating, transformed E. coli were incubated in 10 mL of 100 μg/ml carbenicillin Terrific broth for 3 hours at 37° C. After incubation, 200 microliters (μl) was spread on Isopropyl β-D-1-thiogalactopyranoside (IPTG), Carbenicillin (Carb) Luria-Bertani (LB) plates (+IPTG+CARB LB plates) and incubated at 37° C. overnight. Individual E. coli colonies were grown in 4 mL of +CARB LB media overnight for plasmid isolation using QIAPREP® Spin Miniprep kit (Qiagen Inc.). Isolated plasmids were sequenced using primers T7 (TAATACGACTCACTATAGGG, SEQ ID NO: 643) and pSNAP-SR (CGGATATAGTTCCTCCTTTC, SEQ ID NO: 644) for determination of nucleotide sequence. Plasmids encoding mutants of interest were then re-transformed into T7 Express Competent E. coli, cultured in broth, and grown on agar as previously described. See Puckette et al., J. Virol., 2017, 91: e00924-17 (pages 1-13), which is herein incorporated by reference in its entirety.

1D. Evaluation of Transgene Expression and Processing

HEK293T cells (ATCC CRL-3216) were grown in 6-well plates (VWR International LLC, Radnor, Pa.) using 293 growth media (1× Dulbecco's Modified Eagle's medium (DMEM)), 10% fetal bovine serum, 1× antibiotic-antimycotic and 1× non-essential amino acids). For transfections, cells were rinsed with 2 mL of Dulbecco's phosphate-buffered saline (DPBS). One mL of fresh media was added to each well prior to transfection with 4 μg of plasmid DNA and 10 μL of lipofectamine 2000 (Invitrogen Inc., Carlsbad, Calif.). Cells were grown in a $CO_2$ incubator at 37° C. overnight prior to harvesting.

Luciferase activity was detected in media harvested from transfected cells using a 96-well BioSystems VERITAS™ luminometer (Turner Biosystems Co., Sunnyvale, Calif.) with 100 μL of 1:4 transfection media-diluted sample in each well. Readings were taken immediately upon injection of 100 μL of 50 μg/μl water soluble coelenterazine solution (NANOLIGHT™ Technologies, Prolume, Ltd Pinetop Ariz.) using an integration time of 0.5 seconds both before and after injection of substrate.

Lithium dodecyl sulfate (LDS) Sample Buffer (Invitrogen Inc., Carlsbad, Calif.), heated at 97° C. for 10 minutes, was loaded into wells of a 10-well NUPAGE® 4-12% Bis-Tris gel (Invitrogen Inc.). Gels were electrophoresed in 1×2-(N-morpholino)ethanesulfonic acid (MES) buffer (Invitrogen Inc.) at 200 Volts for 35 minutes then transferred onto membranes using the IBLOT® 2 system (Invitrogen Inc.).

Membranes were incubated in 5% milk blocking buffer for 1 hour at room temperature then washed three times with 1×PBS-TWEEN™ Tablets (MilliporeSigma Inc., St. Louis, Mo.) for 5 minutes each. Primary antibodies were added at 1:50 dilution mouse monoclonal antibodies F1412SA (anti-VP2) and 12FE9.2.1 (anti-VP1), and a 1:250 dilution for anti-VP3 rabbit polyclonal antibody and incubated for 1 hour at room temperature. See Yang et al. *Veterinary Immunology and Immunopathology*, 2007, 115: 126-134 (2007) regarding anti-VP1 and Stave et al., *The Journal of General Virology*, 1986, 67: 2083-2092 regarding anti-VP2)), which is herein incorporated by reference in its entirety.

Membranes were washed three times with 1× Phosphate Buffered Saline with TWEEN® 20 (PBST) for 5 minutes after the primary antibody incubation. 1:500 dilutions of the secondary antibodies, goat anti-mouse-horseradish peroxidase (HRP) and goat anti-rabbit-HRP (KPL) were applied to corresponding membranes for 1 hour at room temperature. After three final washes of 1×PBST, visualization was performed using SIGMAFAS™ 3,3'-diaminobenzidine tablets (MilliporeSigma Inc), as suggested by the manufacturer.

Example 2. Results

2A. Mutations of $B_2$ β Strand Residues (FMDV Residues 123-128)

In FMDV 3C protease crystal structures, the L127 residue is situated on the $B_2$ β strand, which forms a β sheet with the $A_2$ β strand (FIG. 13A). See also Birtley et al., 2005, *The Journal of Biological Chemistry* 280: 11520-11527 (2005), Zunszain et al., *Journal of Molecular Biology,* 2010, 395: 375-389 and Yang et al., 2016, *PeerJ* 4: 4e (2016))), which are each herein incorporated by reference in its entirety, regarding FMDV protease 3C crystal structures. Because proline is known to disrupt strand and β sheet structures, we performed scanning proline mutagenesis for each residue from 123 to 128 using an expression plasmid encoding the FMDV O1 Manisa (O1M) P1, 3C protease and the Δ1D2A-GLuc AIM biomarker (FIG. 13B). Not including L127P, four of the five tested residues resulted in an enhancement of transgene expression over wild-type (FIG. 13C). Of these four mutations, V124P demonstrated the most enhancement over wild-type while D123P, G125P, and I128P had less than one-third of the V124P activity. The L127P mutation maintained the largest enhancement in transgene expression among the $B_2$ β strand proline mutants. Interestingly, mutant R126P had no difference in transgene expression from wild-type (FIG. 13C).

For each mutation, cell lysates from transfected HEK293T cells were examined for processing of the FMDV O1M P1 polypeptide (FIG. 13D). Unlike the C163A activity knockout mutation at the catalytic triad, all six of the mutations retained the ability to process the O1M P1 polypeptide and displayed fully processed VP2 (FIG. 13D). 3C protease does not separate VP0 into VP4 and VP2. Such separation has been reported to be dependent upon proper interactions amongst VP0, VP3, and VP1 during formation of VLPs.

2B. Random Mutagenesis Residues

To identify other novel mutations resulting in a phenotype similar to that of L127P, we conducted a random mutagenesis reaction and induced expression in *E. coli* bacteria to preferentially select for 3C protease mutations that enhance survivability and colony growth. Five different mutations were identified. Two mutations possessed premature stop codons and were not evaluated further. The remaining mutations, T100P, L23P, and L43H, individually present in clones of *E. coli*, were grown on both +CARB/+IPTG and +CARB agar growth medium to evaluate effects on the growth of *E. coli*. As depicted in FIG. 14, only L23P and T100P enhanced *E. coli* colony growth.

For evaluation in the HEK293T mammalian cells, we included adjacent mutations 122P and 199P to better understand if the enhancement was residue specific or, instead, was the result of structural disruption due to proline insertion. HEK293T cells were transfected with pJJP plasmids (FIG. 13B), containing mutants 122P, 123P, 199P or T100P for comparison to WT, L127P, and C163A. All four novel mutations demonstrated enhanced transgene expression when compared to wild-type. As depicted in FIG. 15A, the transgene expression levels were comparable amongst the I22P mutation and L127P.

For each mutation, cell lysates from transfected HEK293T cells were examined for processing of the FMDV O1M P1 polypeptide (FIG. 13D). All mutations, with the exception of the C163A activity knockout, retained the ability to process the O1M P1 polypeptide and displayed fully processed VP2 (FIG. 13D). The separation of VP0 into VP4 and VP2 is not processed by 3C protease and has been described as dependent upon proper interactions amongst VP0, VP3, and VP1 during the formation of VLPs.

Cell lysates were evaluated for P1 processing by western blotting. Different degrees of processing were measured, but none of the new mutants processed P1 as well as the L127P mutant (FIG. 15B). No signs of protein processing with mutant 199P were evident, although a small amount may be detected (FIG. 15B). Mutant T100P processed VP1 partially, as indicated by the presence of VP2, unprocessed P1, and a fusion peptide of VP3 and VP1 (VP3/VP1). Both I22P and L23P demonstrated similar processing profiles, with little P1 detected. However, the presence of VP3/VP1 suggested difficulties processing the junction of VP3 and VP1 (FIG. 15B).

Mutations I22P, L23P, and T100P, retained the ability to process the O1M P1 polypeptide and displayed fully processed VP2 (FIG. 15B). As noted above, the separation of VP0 into VP4 and VP2 is not processed by 3C protease and has been reported to be dependent upon proper interactions amongst VP0, VP3, and VP1 during the formation of VLPs.

2C. Combination of Identified Mutations

Mutations represent alterations to different structures within the $3C^{pro}$. Mutations V124P and L127P are present on the $B_2$ β strand, while I22P is present on the $A_1$ β strand and T100 is found on a loop between the $F_1$ and $A_2$' β strands (FIG. 16). To determine their effects on $3C^{pro}$ activity, we produced combinations of L127P with three mutants identified in this study, i.e., I22P, T100P, and V124P. As depicted in FIG. 17A, the transgene expression level of I22P/T100P/V124P exceeded that of I22P/T100P/L127P (~$7.0\times10^{10}$ Relative Luciferase Units (RLU)/0.5 seconds versus ~$4.5\times10^{10}$ RLU/0.5 seconds).

Three double mutation constructs, I22P/L127P, T100P/L127P, and V124P/L127P, and two triple mutants, I22P/T100P/V124P and I22P/T100P/L127P, were expressed using pJJP plasmids and evaluated for P1 processing (FIG. 17B). Only the V124P/L127P double mutation construct retained a high degree of processing (FIG. 17B). The I22P/L127P construct retained weak processing, but failed to indicate any fully processed product by Western blot. No processed P1 was detected by Western blots for constructs containing T100P/L127P or either of the triple mutants.

2D. Testing of Mutations in CHO-K1 and BHK-21 Cell Lines

The Chinese hamster ovary (CHO) cell line is one of the most widely used cell lines for biopharmaceutical manufacturing. Given its widespread adoption we chose to evaluate if identified mutations to the $3C^{pro}$ continued to enhance transgene expression over wild type and whether VLP array formation is retained. Mutant L127P produced the highest luciferase levels of the single mutations, however all mutations that enhanced output in HEK293-T cells also enhanced output in CHO-K1 cells (FIG. 22).

The Baby Hamster Kidney (BHK-21) cell line has long been used for the production of FMDV inactivated vaccines. Using transfected BHK-21 cells mutant I22P showed the highest luciferase levels with a slightly lower V124P being within range of the standard deviation, FIG. 22. Mutant L127P, while still dramatically superior to WT, showed reduced enhancement relative to 122P, T100P, and V124P (FIG. 22).

Processing efficiency, in both CHO-K1 and BHK-21 cell lines, of tested 3C$^{pro}$ mutants was similar to that observed in HEK293-T cells (FIG. 23A). Electron microscopy confirmed VLP formation with the L127P mutant in transfected CHO-K1 cells (FIG. 23B) and with the V124P mutant in transfected BHK-21 cells (FIG. 23C).

2E. Homologous Residues in Other Picornaviruses

We examined the published 3C protease crystal structures of five additional picornaviruses in relation to the published crystal structure for the FMDV 3C protease (Zunszain et al. *Journal of Molecular Biology*, 2010, 395:375-389) 4 (2016), which is herein incorporated by reference in its entirety. The five additional picornavirus 3C protease crystal structures are as follows: poliovirus (Mosimann et al., *J. Mol. Biol.*, 1997, 273: 1032-1047), Human rhinovirus (Kawatkar et al., *Bioorg. Med. Chem. Lett.*, 2016, 26: 3248-3252, Human enterovirus 71 (Wang et al., *Journal of Virology*, 2011, 85: 10021-10030), coxsackievirus B3 (Lee et al., *J. Biol. Chem.*, 2009, 284: 7646-7655) and Hepatitis A Virus (Bergmann et al., *Journal of Virology*, 1997, 71: 2436-2448))), which are each herein incorporated by reference in its entirety.

2E(i) Residues Homologous to V124P and L127P in Other Picornaviruses

In published FMDV 3C$^{pro}$ crystal structures, the $A_2$-$B_2$ β sheet is not a component of the substrate binding pocket, but is in close proximity to the loop containing the C 163 residue (Birtley et al., 2005, *The Journal of Biological Chemistry*, 280: 11520-11527, Zunszain et al., *Journal of Molecular Biology*, 2010, 395: 375-389, Yang et al., *PeerJ*, 2016, 4: 4e (1964)), which are each herein incorporated by reference in its entirety. This finding led to speculation that the $A_2$-$B_2$ β sheet plays a role in substrate specificity (Birtley et al., 2005, *The Journal of Biological Chemistry*, 280: 11520-11527), which is herein incorporated by reference in its entirety. The side chains of residues V124 and L127 are the closest residues on the $B_2$ β strand to the side chain of residue Y162, which is adjacent to catalytic residue C163 (FIGS. 18A and 18B). Together with residues I119 and N121 of the $A_2$ strand, the side chains of these residues are directed towards the side chain of Y162 (FIG. 18A). This provides a close point of contact for the $B_2$ β strand, the 3C$^{pro}$ binding pocket, and the catalytic triad. Neither mutant V124P nor L127P decreased proteolytic activity, suggesting that they do not severely impact the catalytic triad. The close proximity of V124P and L127P to residue Y162 may provide the means through which the mutation of either residue to proline results in a diminished capacity of 3C$^{pro}$ to easily process host proteins (FIG. 18B). Similar structures are observed in other picornaviruses by examining the location of the residue immediately adjacent to the catalytic cysteine in relation to the side chain of strand structures (FIG. 19). The catalytic cysteine is residue 163 in FMDV, 172 in Hepatitis A Virus, and 147 in poliovirus, Human rhinovirus, Human enterovirus 71, and coxsackievirus B3. This led us to examine the interactions of side chains on nearby strand structures with residues 171 for Hepatitis A virus and 146 for poliovirus, Human rhinovirus, Human enterovirus 71, and coxsackievirus B3. We suggest that the following residues, if mutated, may result in reduction of 3C protease's adverse effects on host cell proteins: M128, I130, T121, and L119 for Hepatitis A Virus; V104, L102, and T142 for poliovirus; Q108, T112, I114, L102, and L104 for Human rhinovirus; T106, M109, and I104 for Human enterovirus 71; and M112, I114, F109, I104, and L102 for coxsackievirus B3.

2E(ii). Residues Homologous to I22P and L23P in Other Picornaviruses

In FMDV, residues 122P and L23P are part of the $A_1$ β strand, which pairs with the $B_1$ β strand (FIG. 18C). The $A_1$-$B_1$ β strand pair, including residues 18-31, is adjacent to the peptide binding pocket, FIG. 18C, and undergoes conformational changes upon binding to substrate. See Zunszain et al., *Journal of Molecular Biology*, 2010, 395: 375-389, which is herein incorporated by reference in its entirety. This suggests that mutations 122P and L23P may impact substrate binding through alterations of the $A_1$ β strand structure which results in changes in the structure of the $A_1$-$B_1$ β strand pair. These alterations may influence the size and shape of the binding pocket disrupting substrate specificity.

Similar structures were observed in other picornaviruses by examining the residues of the β-sheet structure connected to the N-terminal helical domain (FIG. 20). This led to the identification of the following residues that, if mutated, may result in reduction of 3C protease host cell protein processing. Residues T20 and T19 in poliovirus, T20 and T19 in Human rhinovirus, T20 and Q19 in Human enterovirus 71, T20 and K19 in coxsackievirus B3, and E20 and G19 in Hepatitis A virus, FIG. 20.

2E(iii) Residues Homologous to T100P in Other Picornaviruses

In FMDV, mutants 199P and T100P represent different P1 processing results despite being adjacent. Both are distal from the binding site and localized in the loop between the $A_2'$ β strand and the $F_1$ β strand, and in close proximity to the N- and C-terminal α helixes (FIG. 18D). It is possible that the disruption in total processing observed with 199P in contrast to that of T100P are facilitated through an influence of one or both of the terminal helices and subsequent disruptions in protein structure resulting from this interaction.

A similar structure was observed in other picornavirus 3C protease structures. In particular, the structure of a loop region following a 3 strand structure located between the N- and C-termini of the protein was present in all structures (FIG. 21). This led to the identification of the following residues that, if mutated, may result in reduction of 3C protease's adverse effects: residue R87 in poliovirus, R87 and R88 in Human rhinovirus, T87 and K88 in Human enterovirus 71, R87 and L90 in coxsackievirus B3, and T100 and Q101 in Hepatitis A virus (FIG. 21).

Example 3. Alignments of Primary Amino Acid Sequences

Alignments of a primary amino acid sequence of an FMDV 3C protease with 3C proteases from other picornaviral species are depicted in FIGS. 4-12. Alignments were prepared using Clone Manager 9, Professional Edition, Version 9.4, 1 Jan. 2015, using Blossum 62, default parameters. The primary sequence alignments show the amino acids residues in non-FMDV picornaviral 3C proteases that correspond to, e.g., V124, L127, 122, L23 and T100 in FMDV 3C protease. The corresponding amino acids identified in the primary sequence alignments are generally consistent with those identified using the structural homology analysis described above.

SEQUENCE LISTING (655 sequences)

SEQ ID NO: 1 - DNA, 639 bp, Foot-and-mouth disease virus
  CDS (1)..(639)
  misc_feature (1)..(639): WT_A_2006
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 2 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 3 - DNA, 639 bp, Foot-and-mouth disease virus
  CDS (1)..(639)
  misc_feature (1)..(639): WT_A24
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 4 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 5 - DNA, 639 bp, Foot-and-mouth disease virus
  CDS (1)..(639)
  misc_feature (1)..(639): WT_Asia_leb_89
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 6 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 7 - DNA, 639 bp, Foot-and-mouth disease virus
  CDS (1)..(639)
  misc_feature (1)..(639): WT_Asia1_Shamir
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 8 - protein, 213 aa, Foot-and-mouth disease virus; identical to SEQ ID NO: 6

SEQ ID NO: 9 - DNA, 639 bp, Foot-and-mouth disease virus
  CDS (1)..(639): WT_C3
  misc_feature (1)..(639): WT_C3
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 10 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 11 - DNA, 639 bp, Foot-and-mouth disease virus
  CDS (1)..(639)
  misc_feature (1)..(639): WT_O_pan_asia
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 12 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 13 - DNA, 639 bp, Foot-and-mouth disease virus
  CDS (1)..(639)
  misc_feature (1)..(639): WT_O1_Manissa
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 14 - protein, 213 aa, Foot-and-mouth disease virus; identical to SEQ ID NO: 10

SEQ ID NO: 15 - DNA, 639 bp, Foot-and-mouth disease virus
  CDS (1)..(639)
  misc_feature (1)..(639): WT_SAT1
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 16 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 17 - DNA, 639 bp, Foot-and-mouth disease virus
  CDS (1)..(639)
  misc_feature (1)..(639): WT_SAT2_Egypt_2010
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 18 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 19 - DNA, 639 bp, Foot-and-mouth disease virus
  CDS (1)..(639)
  misc_feature (1)..(639): WT_SAT3
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 20 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 21 - DNA, 639 bp, Foot-and-mouth disease virus
  CDS (1)..(639)
  misc_feature (1)..(639): D123P_A_2006
  misc_feature (369)..(369): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctccngtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 22 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNAPVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 23 - DNA, 639 bp, Foot-and-mouth disease virus
  CDS (1)..(639)
  misc_feature (1)..(639): D123P_A24
  misc_feature (369)..(369): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccccngtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 24 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNAPVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 25 - DNA, 639 bp, Foot-and-mouth disease virus
  CDS (1)..(639)
  misc_feature (1)..(639): D123P_Asia_leb_89
  misc_feature (369)..(369): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccccngttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 26 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNAPVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 27 - DNA, 639 bp, Foot-and-mouth disease virus
  CDS (1)..(639)
  misc_feature (1)..(639): D123P_Asia1_Shamir
  misc_feature (369)..(369): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccccngttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 28 - protein, 213 aa, Foot-and-mouth disease virus; identical to SEQ ID NO: 26

SEQ ID NO: 29 - DNA, 639 bp, Foot-and-mouth disease virus
  CDS (1)..(639)
  misc_feature (1)..(639): D123P_C3
  misc_feature (369)..(369): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccccngttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 30 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNAPVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 31 - DNA, 639 bp, Foot-and-mouth disease virus
  CDS (1)..(639)
  misc_feature (1)..(639): D123P_O_pan_asia
  misc_feature (369)..(369): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccccngtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 32 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNAPVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 33 - DNA, 639 bp, Foot-and-mouth disease virus
  CDS (1)..(639)
  misc_feature (1)..(639): D123P_O1_Manissa
  misc_feature (369)..(369): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccccngttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 34 - protein, 213 aa, Foot-and-mouth disease virus; identical to SEQ ID NO: 30

SEQ ID NO: 35 - DNA, 639 bp, Foot-and-mouth disease virus
  CDS (1)..(639)
  misc_feature (1)..(639): D123P_SAT1
  misc_feature (369)..(369): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccccngtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 36 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNAPVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 37 - DNA, 639 bp, Foot-and-mouth disease virus
  CDS (1)..(639)
  misc_feature (1)..(639): D123P_SAT2_Egypt_2010
  misc_feature (369)..(369): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccccngttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 38 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNAPVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 39 - DNA, 639 bp, Foot-and-mouth disease virus
  CDS (1)..(639)
  misc_feature (1)..(639): D123P_SAT3
  misc_feature (369)..(369): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctccngtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 40 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNAPVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 41 - DNA, 639 bp, Foot-and-mouth disease virus
  CDS (1)..(639)
  misc_feature (1)..(639): G125P_A_2006
  misc_feature (375)..(375): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcccnagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 42 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVPRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 43 - DNA, 639 bp, Foot-and-mouth disease virus
  CDS (1)..(639)
  misc_feature (1)..(639): G125P_A24
  misc_feature (375)..(375): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcccnagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 44 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVPRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 45 - DNA, 639 bp, Foot-and-mouth disease virus
  CDS (1)..(639)
  misc_feature (1)..(639): G125P_Asia_leb_89
  misc_feature (375)..(375): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttccnagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 46 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVPRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 47 - DNA, 639 bp, Foot-and-mouth disease virus
  CDS (1)..(639)
  misc_feature (1)..(639): G125P_Asia1_Shamir
  misc_feature (375)..(375): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttccnagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 48 - protein, 213 aa, Foot-and-mouth disease virus; identical to SEQ ID NO: 46

SEQ ID NO: 49 - DNA, 639 bp, Foot-and-mouth disease virus
  CDS (1)..(639)
  misc_feature (1)..(639): G125P_C3
  misc_feature (375)..(375): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttccnagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 50 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVPRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 51 - DNA, 639 bp, Foot-and-mouth disease virus
  CDS (1)..(639)
  misc_feature (1)..(639): G125P_O_pan_asia
  misc_feature (375)..(375): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcccnagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 52 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVPRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 53 - DNA, 639 bp, Foot-and-mouth disease virus
  CDS (1)..(639)
  misc_feature (1)..(639): G125P_O1_Manissa
  misc_feature (375)..(375): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttccnagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 54 - protein, 213 aa, Foot-and-mouth disease virus; identical to SEQ ID NO: 50

SEQ ID NO: 55 - DNA, 639 bp, Foot-and-mouth disease virus
  CDS (1)..(639)
  misc_feature (1)..(639): G125P_SAT1
  misc_feature (375)..(375): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcccnagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 56 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVPRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 57 - DNA, 639 bp, Foot-and-mouth disease virus
  CDS (1)..(639)
  misc_feature (1)..(639): G125P_SAT2_Egypt_2010
  misc_feature (375)..(375): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttccnagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 58 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVPRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 59 - DNA, 639 bp, Foot-and-mouth disease virus
  CDS (1)..(639)
  misc_feature (1)..(639): G125P_SAT3
  misc_feature (375)..(375): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcccnagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 60 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVPRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 61 - DNA, 639 bp, Foot-and-mouth disease virus
  CDS (1)..(639)
  misc_feature (1)..(639): I128P_A_2006
  misc_feature (384)..(384): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgccnttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 62 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLPFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 63 - DNA, 639 bp, Foot-and-mouth disease virus
  CDS (1)..(639)
  misc_feature (1)..(639): I128P_A24
  misc_feature (384)..(384): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgccnttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 64 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLPFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 65 - DNA, 639 bp, Foot-and-mouth disease virus
  CDS (1)..(639)
  misc_feature (1)..(639): I128P_Asia_leb_89
  misc_feature (384)..(384): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgccnttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 66 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLPFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 67 - DNA, 639 bp, Foot-and-mouth disease virus
  CDS (1)..(639)
  misc_feature (1)..(639): I128P_Asia1_Shamir
  misc_feature (384)..(384): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgccnttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 68 - protein, 213 aa, Foot-and-mouth disease virus; identical to SEQ ID NO: 66

SEQ ID NO: 69 - DNA, 639 bp, Foot-and-mouth disease virus
  CDS (1)..(639)
  misc_feature (1)..(639): I128P_C3
  misc_feature (384)..(384): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgccnttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 70 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLPFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 71 - DNA, 639 bp, Foot-and-mouth disease virus
  CDS (1)..(639)
  misc_feature (1)..(639): I128P_O_pan_asia
  misc_feature (384)..(384): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgccnttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 72 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLPFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 73 - DNA, 639 bp, Foot-and-mouth disease virus
  CDS (1)..(639)
  misc_feature (1)..(639): I128P_O1_Manissa
  misc_feature (384)..(384): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgccnttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 74 - protein, 213 aa, Foot-and-mouth disease virus; identical to SEQ ID NO: 70

SEQ ID NO: 75 - DNA, 639 bp, Foot-and-mouth disease virus
  CDS (1)..(639)
  misc_feature (1)..(639): I128P_SAT1
  misc_feature (384)..(384): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcccnttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 76 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLPFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 77 - DNA, 639 bp, Foot-and-mouth disease virus
  CDS (1)..(639)
  misc_feature (1)..(639): I128P_SAT2_Egypt_2010
  misc_feature (384)..(384): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcccnttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 78 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLPFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 79 - DNA, 639 bp, Foot-and-mouth disease virus
  CDS (1)..(639)
  misc_feature (1)..(639): I128P_SAT3
  misc_feature (384)..(384): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcccnttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 80 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLPFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 81 - DNA, 639 bp, Foot-and-mouth disease virus
  CDS (1)..(639)
  misc_feature (1)..(639): I22P_A_2006
  misc_feature (66)..(66): n is c, g, a, t/u
agtggtgcccccccgaccgacttgcaaaagatggtcatgggcaacaccaagcctgttgagctcccnctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 82 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 83 - DNA, 639 bp, Foot-and-mouth disease virus
  CDS (1)..(639)
  misc_feature (1)..(639): I22P_A24
  misc_feature (66)..(66): n is c, g, a, t/u
agtggtgccccaccgaccgacttgcaaaagttggtcatgggcaacaccaagcccgttgagctcccncttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 84 - protein, 213 aa, Foot-and-mouth disease virus
SGAPPTDLQKLVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 85 - DNA, 639 bp, Foot-and-mouth disease virus
  CDS (1)..(639)
  misc_feature (1)..(639): I22P_Asia_leb_89
  misc_feature (66)..(66): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 86 - protein, 213 aa, Foot-and-mouth disease virus
SGAPPTDLQKMVMSNTKPVELPLDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 87 - DNA, 639 bp, Foot-and-mouth disease virus
  CDS (1)..(639)
  misc_feature (1)..(639): I22P_Asia1_Shami
  misc_feature (66)..(66): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 88 - protein, 213 aa, Foot-and-mouth disease virus; identical to SEQ ID NO: 86

SEQ ID NO: 89 - DNA, 639 bp, Foot-and-mouth disease virus
  CDS (1)..(639)
  misc_feature (1)..(639): I22P_C3
  misc_feature (66)..(66): n is c, g, a, t/u
agcggtgccccaccgaccgacttgcaaaagatggtcatgggcaacaccaagcctgttgagctgccnctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 90 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 91 - DNA, 639 bp, Foot-and-mouth disease virus
  CDS (1)..(639)
  misc_feature (1)..(639): I22P_O_pan_asia
  misc_feature (66)..(66): n is c, g, a, t/u
agtggtgctccaccgactgacttgcaaaagatggtcatgggtaacaccaagcccgttgagctcccncttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 92 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 93 - DNA, 639 bp, Foot-and-mouth disease virus
  CDS (1)..(639)
  misc_feature (1)..(639): I22P_O1_Manissa
  misc_feature (66)..(66): n is c, g, a, t/u
agtggtgccccaccgaccgacttgcagaagatggtcatgggcaacactaagcctgttgagctcccnctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 94 - protein, 213 aa, Foot-and-mouth disease virus; identical to SEQ ID NO: 90

SEQ ID NO: 95 - DNA, 639 bp, Foot-and-mouth disease virus
  CDS (1)..(639)
  misc_feature (1)..(639): I22P_SAT1
  misc_feature (66)..(66): n is c, g, a, t/u
agcggatgtccaccgaccgacctgcagaggatggtcatggcaaacgtgaaacccgttgagctcccnctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 96 - protein, 213 aa, Foot-and-mouth disease virus
SGCPPTDLQRMVMANVKPVELPLDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 97 - DNA, 639 bp, Foot-and-mouth disease virus
  CDS (1)..(639)
  misc_feature (1)..(639): I22P_SAT2_Egypt_2010
  misc_feature (66)..(66): n is c, g, a, t/u
agtggagcgccacccaccgacttgcaaaagatggtgatggccaacaccaaaccagtcgagctcccnctcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 98 - protein, 213 aa, Foot-and-mouth disease virus
SGAPPTDLQKMVMANTKPVELPLDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 99 - DNA, 639 bp, Foot-and-mouth disease virus
  CDS (1)..(639)
  misc_feature (1)..(639): I22P_SAT3
  misc_feature (66)..(66): n is c, g, a, t/u
agcggatgcccaccgaccgacttgcaaaagatggtcatggcaaacgtaaagcctgttgagctcccnctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 100 - protein, 213 aa, Foot-and-mouth disease virus
SGCPPTDLQKMVMANVKPVELPLDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 101 - DNA, 639 bp, Foot-and-mouth disease virus
  CDS (1)..(639)
  misc_feature (1)..(639): I99P_A_2006
  misc_feature (297)..(297): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacccnacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 102 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDPTKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 103 - DNA, 639 bp, Foot-and-mouth disease virus
  CDS (1)..(639)
  misc_feature (1)..(639): I99P_A24
  misc_feature (297)..(297): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacccnacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 104 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDPTKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 105 - DNA, 639 bp, Foot-and-mouth disease virus
  CDS (1)..(639)
  misc_feature (1)..(639): I99P_Asia_leb_89
  misc_feature (297)..(297): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacccnacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 106 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDPTKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 107 - DNA, 639 bp, Foot-and-mouth disease virus
  CDS (1)..(639)
  misc_feature (1)..(639): I99P_Asia_Shamir
  misc_feature (297)..(297): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacccnacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 108 - protein, 213 aa, Foot-and-mouth disease virus; identical to SEQ ID NO: 106

SEQ ID NO: 109 - DNA, 639 bp, Foot-and-mouth disease virus
  CDS (1)..(639)
  misc_feature (1)..(639): I99P_C3
  misc_feature (297)..(297): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacccnacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 110 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDPTKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 111 - DNA, 639 bp, Foot-and-mouth disease virus
  CDS (1)..(639)
  misc_feature (1)..(639): I99P_O_pan_asia
  misc_feature (297)..(297): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacccnacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 112 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDPTKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 113 - DNA, 639 bp, Foot-and-mouth disease virus
  CDS (1)..(639)
  misc_feature (1)..(639): I99P_01_Manissa
  misc_feature (297)..(297): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacccnacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 114 - protein, 213 aa, Foot-and-mouth disease virus; identical to SEQ ID NO: 110

SEQ ID NO: 115 - DNA, 639 bp, Foot-and-mouth disease virus
  CDS (1)..(639)
  misc_feature (1)..(639): I99P_SAT2_Egypt_2010
  misc_feature (297)..(297): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacccnacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 116 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDPTKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 117 - DNA, 639 bp, Foot-and-mouth disease virus
  CDS (1)..(639)
  misc_feature (1)..(639): L127P_A_2006
  misc_feature (381)..(381): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagaccnattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 118 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 119 - DNA, 639 bp, Foot-and-mouth disease virus
  CDS (1)..(639)
  misc_feature (1)..(639): L127P_A24
  misc_feature (381)..(381): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagaccnattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 120 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 121 - DNA, 639 bp, Foot-and-mouth disease virus
  CDS (1)..(639)
  misc_feature (1)..(639): L127P_Asia_leb_89
  misc_feature (381)..(381): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccnattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 122 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 123 - DNA, 639 bp, Foot-and-mouth disease virus; identical to SEQ ID NO: 121
  CDS (1)..(639)
  misc_feature (1)..(639): L127P_Asia1_Shamir
  misc_feature (381)..(381): n is c, g, a, t/u

SEQ ID NO: 124 - protein, 213 aa, Foot-and-mouth disease virus; identical to SEQ ID NO: 122

SEQ ID NO: 125 - DNA, 639 bp, Foot-and-mouth disease virus
  CDS (1)..(639)
  misc_feature (1)..(639): L127P_C3
  misc_feature (381)..(381): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagaccnattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 126 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 127 - DNA, 639 bp, Foot-and-mouth disease virus
  CDS (1)..(639)
  misc_feature (1)..(639): L127P_O_pan_asia
  misc_feature (381)..(381): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagaccnattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 128 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 129 - DNA, 639 bp, Foot-and-mouth disease virus
  CDS (1)..(639)
  misc_feature (1)..(639): L127P_01_Manissa
  misc_feature (381)..(381): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagaccnattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 130 - protein, 213 aa, Foot-and-mouth disease virus; identical to SEQ ID NO: 126

SEQ ID NO: 131 - DNA, 639 bp, Foot-and-mouth disease virus
  CDS (1)..(639)
  misc_feature (1)..(639): L127P_SAT1
  misc_feature (381)..(381): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagaccnatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 132 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 133 - DNA, 639 bp, Foot-and-mouth disease virus
  CDS (1)..(639)
  misc_feature (1)..(639): L127P_SAT2_Egypt_2010
  misc_feature (381)..(381): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagaccnatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 134 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 135 - DNA, 639 bp, Foot-and-mouth disease virus
  CDS (1)..(639)
  misc_feature (1)..(639): L127P_SAT3
  misc_feature (381)..(381): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagaccnatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 136 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 137 - DNA, 639 bp, Foot-and-mouth disease virus
  CDS (1)..(639)
  misc_feature (1)..(639): L23P_A_2006
  misc_feature (69)..(69): n is c, g, a, t/u
agtggtgcccccccgaccgacttgcaaaagatggtcatgggcaacaccaagcctgttgagctcatcccngacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 138 - protein, 213 aa, Foot-and-mouth disease virus
SGAPPTDLQKMVMGNTKPVELIPDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 139 - DNA, 639 bp, Foot-and-mouth disease virus
  CDS (1)..(639)
  misc_feature (1)..(639): L23P_A24
  misc_feature (69)..(69): n is c, g, a, t/u
agtggtgccccaccgaccgacttgcaaaagttggtcatgggcaacaccaagcccgttgagctcatcccngacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 140 - protein, 213 aa, Foot-and-mouth disease virus
SGAPPTDLQKLVMGNTKPVELIPDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 141 - DNA, 639 bp, Foot-and-mouth disease virus
  CDS (1)..(639)
  misc_feature (1)..(639): L23P_Asia_leb_89
  misc_feature (69)..(69): n is c, g, a, t/u
agtggtgccccaccgaccgacttgcaaaagatggtcatgagcaacactaagcctgttgagctcatcccngacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 142 - protein, 213 aa, Foot-and-mouth disease virus
SGAPPTDLQKMVMSNTKPVELIPDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 143 - DNA, 639 bp, Foot-and-mouth disease virus
  CDS (1)..(639)
  misc_feature (1)..(639): L23P_Asia_Shamir
  misc_feature (69)..(69): n is c, g, a, t/u
agtggtgccccaccgaccgacttgcaaaagatggtcatgagcaacactaagcctgttgagctcatcccngacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 144 - protein, 213 aa, Foot-and-mouth disease virus; identical to SEQ ID NO: 142

SEQ ID NO: 145 - DNA, 639 bp, Foot-and-mouth disease virus
  CDS (1)..(639)
  misc_feature (1)..(639): L23P_C3
  misc_feature (69)..(69): n is c, g, a, t/u
agcggtgccccaccgaccgacttgcaaaagatggtcatgggcaacaccaagcctgttgagctgattccngatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 146 - protein, 213 aa, Foot-and-mouth disease virus
SGAPPTDLQKMVMGNTKPVELIPDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 147 - DNA, 639 bp, Foot-and-mouth disease virus
  CDS (1)..(639)
  misc_feature (1)..(639): L23P_O_pan_asia
  misc_feature (69)..(69): n is c, g, a, t/u
agtggtgctccaccgactgacttgcaaaagatggtcatgggtaacaccaagcccgttgagctcataccngacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 148 - protein, 213 aa, Foot-and-mouth disease virus
SGAPPTDLQKMVMGNTKPVELIPDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 149 - DNA, 639 bp, Foot-and-mouth disease virus
  CDS (1)..(639)
  misc_feature (1)..(639): L23P_01_Manissa
  misc_feature (69)..(69): n is c, g, a, t/u
agtggtgccccaccgaccgacttgcagaagatggtcatgggcaacactaagcctgttgagctcatcccngacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 150 - protein, 213 aa, Foot-and-mouth disease virus; identical to SEQ ID NO: 146

SEQ ID NO: 151 - DNA, 639 bp, Foot-and-mouth disease virus
  CDS (1)..(639)
  misc_feature (1)..(639): L23P_SAT1
  misc_feature (69)..(69): n is c, g, a, t/u
agcggatgtccaccgaccgacctgcagaggatggtcatggcaaacgtgaaacccgttgagctcatcccngatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 152 - protein, 213 aa, Foot-and-mouth disease virus
SGCPPTDLQRMVMANVKPVELIPDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 153 - DNA, 639 bp, Foot-and-mouth disease virus
  CDS (1)..(639)
  misc_feature (1)..(639): L23P_SAT2_Egypt_2010
  misc_feature (69)..(69): n is c, g, a, t/u
agtggagcgccacccaccgacttgcaaaagatggtgatggccaacaccaaaccagtcgagctcataccngatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 154 - protein, 213 aa, Foot-and-mouth disease virus
SGAPPTDLQKMVMANTKPVELIPDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 155 - DNA, 639 bp, Foot-and-mouth disease virus
  CDS (1)..(639)
  misc_feature (1)..(639): L23P_SAT3
  misc_feature (69)..(69): n is c, g, a, t/u
agcggatgcccaccgaccgacttgcaaaagatggtcatggcaaacgtaaagcctgttgagctcatcccngacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 156 - protein, 213 aa, Foot-and-mouth disease virus
SGCPPTDLQKMVMANVKPVELIPDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 157 - DNA, 639 bp, Foot-and-mouth disease virus
  CDS (1)..(639)
  misc_feature (1)..(639): L42H_A_2006
  misc_feature (126)..(126)
agtggtgcccccccgaccgacttgcaaaagatggtcatgggcaacaccaagcctgttgagctcatcctcgacgggaagacggtagccatctgttgcgctaccggagtgtttggcactgcttaccaygtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 158 - protein, 213 aa, Foot-and-mouth disease virus
SGAPPTDLQKMVMGNTKPVELILDGKTVAICCATGVFGTAYHVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 159 - DNA, 639 bp, Foot-and-mouth disease virus
  CDS (1)..(639)
  misc_feature (1)..(639): L42H_A24
  misc_feature (126)..(126)
agtggtgccccaccgaccgacttgcaaaagttggtcatgggcaacaccaagcccgttgagctcatccttgacgggaagacggtagccatttgctgtgctactggagttttcggcactgcttaccaygtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 160 - protein, 213 aa, Foot-and-mouth disease virus
SGAPPTDLQKLVMGNTKPVELILDGKTVAICCATGVFGTAYHVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 161 - DNA, 639 bp, Foot-and-mouth disease virus
  CDS (1)..(639)
  misc_feature (1)..(639): L42H_Asia_leb_89
  misc_feature (126)..(126)
agtggtgccccaccgaccgacttgcaaaagatggtcatgagcaacactaagcctgttgagctcatccttgacggtaagacggtggccatctgctgcgccaccggagtgtttggtactgcctaccaygtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 162 - protein, 213 aa, Foot-and-mouth disease virus
SGAPPTDLQKMVMSNTKPVELILDGKTVAICCATGVFGTAYHVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 163 - DNA, 639 bp, Foot-and-mouth disease virus
  CDS (1)..(639)
  misc_feature (1)..(639): L42H_Asia1_Shamir
  misc_feature (126)..(126)
agtggtgccccaccgaccgacttgcaaaagatggtcatgagcaacactaagcctgttgagctcatccttgacggtaagacggtggccatctgctgcgccaccggagtgtttggtactgcctaccaygtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 164 - protein, 213 aa, Foot-and-mouth disease virus; identical to SEQ ID NO: 162

SEQ ID NO: 165 - DNA, 639 bp, Foot-and-mouth disease virus
  CDS (1)..(639)
  misc_feature (1)..(639): L42H_C3
  misc_feature (126)..(126)
agcggtgccccaccgaccgacttgcaaaagatggtcatgggcaacaccaagcctgttgagctgattctcgatgggaagacggtggccatctgctgcgccaccggagtgtttggcactgcttaccaygtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 166 - protein, 213 aa, Foot-and-mouth disease virus
SGAPPTDLQKMVMGNTKPVELILDGKTVAICCATGVFGTAYHVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 167 - DNA, 639 bp, Foot-and-mouth disease virus
  CDS (1)..(639)
  misc_feature (1)..(639): L42H_O_pan_asia
  misc_feature (126)..(126)
agtggtgctccaccgactgacttgcaaaagatggtcatgggtaacaccaagcccgttgagctcatacttgacgggaagacagtagccatctgctgtgctactggagtgtttggcaccgcctaccaygtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 168 - protein, 213 aa, Foot-and-mouth disease virus
SGAPPTDLQKMVMGNTKPVELILDGKTVAICCATGVFGTAYHVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 169 - DNA, 639 bp, Foot-and-mouth disease virus
  CDS (1)..(639)
  misc_feature (1)..(639): L42H_01_Manissa
  misc_feature (126)..(126)
agtggtgccccaccgaccgacttgcagaagatggtcatgggcaacactaagcctgttgagctcatcctcgacgggaagacggtagccatctgctgtgctaccggagtgtttggcactgcctaccaygtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 170 - protein, 213 aa, Foot-and-mouth disease virus; identical to SEQ ID NO: 166

SEQ ID NO: 171 - DNA, 639 bp, Foot-and-mouth disease virus
  CDS (1)..(639)
  misc_feature (1)..(639): L42H_SAT1
  misc_feature (126)..(126)
agcggatgtccaccgaccgacctgcagaggatggtcatggcaaacgtgaaacccgttgagctcatcctcgatgggaagaccgttgcgctctgctgcgctacgggagtgttcgggacggcttatcaygtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 172 - protein, 213 aa, Foot-and-mouth disease virus
SGCPPTDLQRMVMANVKPVELILDGKTVALCCATGVFGTAYHVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 173 - DNA, 639 bp, Foot-and-mouth disease virus
  CDS (1)..(639)
  misc_feature (1)..(639): L42H_SAT_Egypt_2010
  misc_feature (126)..(126)
agtggagcgccacccaccgacttgcaaaagatggtgatggccaacaccaaaccagtcgagctcatactcgatggtaagacagtggcgatctgctgtgccactggagtgtttgggactgcctatcaygtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 174 - protein, 213 aa, Foot-and-mouth disease virus
SGAPPTDLQKMVMANTKPVELILDGKTVAICCATGVFGTAYHVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 175 - DNA, 639 bp, Foot-and-mouth disease virus
  CDS (1)..(639)
  misc_feature (1)..(639): L42H_SAT3
  misc_feature (126)..(126)
agcggatgcccaccgaccgacttgcaaaagatggtcatggcaaacgtaaagcctgttgagctcatcctcgacgggaagaccgttgcgctctgctgcgcgacgggagtgtttgggacagcttaccaygtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 176 - protein, 213 aa, Foot-and-mouth disease virus
SGCPPTDLQKMVMANVKPVELILDGKTVALCCATGVFGTAYHVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 177 - DNA, 639 bp, Foot-and-mouth disease virus
  CDS (1)..(639)
  misc_feature (1)..(639): L99P_SAT1
  misc_feature (297)..(297): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatccnacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 178 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDPTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 179 - DNA, 639 bp, Foot-and-mouth disease virus
  CDS (1)..(639)
  misc_feature (1)..(639): L99P_SAT3
  misc_feature (297)..(297): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatccnacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 180 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDPTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 181 - DNA, 639 bp, Foot-and-mouth disease virus
  CDS (1)..(639)
  misc_feature (1)..(639): R126P_A_2006
  misc_feature (378)..(378): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggccnctgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 182 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGPLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 183 - DNA, 639 bp, Foot-and-mouth disease virus
  CDS (1)..(639)
  misc_feature (1)..(639): R126P_A24
  misc_feature (378)..(378): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggccnctgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 184 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGPLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 185 - DNA, 639 bp, Foot-and-mouth disease virus
  CDS (1)..(639)
  misc_feature (1)..(639): R126P_Asia_leb_88
  misc_feature (378)..(378): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggccnctgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 186 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGPLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 187 - DNA, 639 bp, Foot-and-mouth disease virus
  CDS (1)..(639)
  misc_feature (1)..(639): R126P_Asia_Shamir
  misc_feature (378)..(378): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggccnttgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 188 - protein, 213 aa, Foot-and-mouth disease virus; identical to SEQ ID NO: 186

SEQ ID NO: 189 - DNA, 639 bp, Foot-and-mouth disease virus
  CDS (1)..(639)
  misc_feature (1)..(639): R126P_C3
  misc_feature (378)..(378): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggccnctgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 190 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGPLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 191 - DNA, 639 bp, Foot-and-mouth disease virus
  CDS (1)..(639)
  misc_feature (1)..(639): R126_O_pan_asia
  misc_feature (378)..(378): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggccnctgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 192 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGPLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 193 - DNA, 639 bp, Foot-and-mouth disease virus
  CDS (1)..(639)
  misc_feature (1)..(639): R126P_01_Manissa
  misc_feature (378)..(378): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggccnctgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 194 - protein, 213 aa, Foot-and-mouth disease virus; identical to SEQ ID NO: 190

SEQ ID NO: 195 - DNA, 639 bp, Foot-and-mouth disease virus
  CDS (1)..(639)
  misc_feature (1)..(639): R126P_SAT1
  misc_feature (378)..(378): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaccnctcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 196 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGPLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 197 - DNA, 639 bp, Foot-and-mouth disease virus
  CDS (1)..(639)
  misc_feature (1)..(639): R126_SAT_Egypt_2010
  misc_feature (378)..(378): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggccnctcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 198 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGPLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 199 - DNA, 639 bp, Foot-and-mouth disease virus
  CDS (1)..(639)
  misc_feature (1)..(639): R126P_SAT3
  misc_feature (378)..(378): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaccnctcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 200 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGPLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 201 - DNA, 639 bp, Foot-and-mouth disease virus
  CDS (1)..(639)
  misc_feature (1)..(639): T100P_A_2006
  misc_feature (300)..(300): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcccnaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 202 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 203 - DNA, 639 bp, Foot-and-mouth disease virus
  CDS (1)..(639)
  misc_feature (1)..(639): T100P_A24
  misc_feature (300)..(300): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcccnaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 204 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 205 - DNA, 639 bp, Foot-and-mouth disease virus
  CDS (1)..(639)
  misc_feature (1)..(639): T100P_Asia_leb_89
  misc_feature (300)..(300): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 206 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDIPKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 207 - DNA, 639 bp, Foot-and-mouth disease virus
  CDS (1)..(639)
  misc_feature (1)..(639): T100P_Asia1_Shamir
  misc_feature (300)..(300): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 208 - protein, 213 aa, Foot-and-mouth disease virus; identical to SEQ ID NO: 206

SEQ ID NO: 209 - DNA, 639 bp, Foot-and-mouth disease virus
  CDS (1)..(639)
  misc_feature (1)..(639): T100P_C3
  misc_feature (300)..(300): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcccnaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 210 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 211 - DNA, 639 bp, Foot-and-mouth disease virus
  CDS (1)..(639)
  misc_feature (1)..(639): T100P_O_pan_asia
  misc_feature (300)..(300): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcccnaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 212 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 213 - DNA, 639 bp, Foot-and-mouth disease virus
  CDS (1)..(639)
  misc_feature (1)..(639): T100P_O1_Manissa
  misc_feature (300)..(300): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcccnaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 214 - protein, 213 aa, Foot-and-mouth disease virus; identical to SEQ ID NO: 210

SEQ ID NO: 215 - DNA, 639 bp, Foot-and-mouth disease virus
  CDS (1)..(639)
  misc_feature (1)..(639): T100P_SAT1
  misc_feature (300)..(300): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcccnggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 216 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 217 - DNA, 639 bp, Foot-and-mouth disease virus
  CDS (1)..(639)
  misc_feature (1)..(639): T100P_SAT_Egypt_2010
  misc_feature (300)..(300): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcccnaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 218 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDIPKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 219 - DNA, 639 bp, Foot-and-mouth disease virus
  CDS (1)..(639)
  misc_feature (1)..(639): T100P_SAT3
  misc_feature (300)..(300): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcccnggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 220 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 221 - DNA, 639 bp, Foot-and-mouth disease virus
  CDS (1)..(639)
  misc_feature (1)..(639): V124P_A_2006
  misc_feature (372)..(372): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatccngggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 222 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 223 - DNA, 639 bp, Foot-and-mouth disease virus
  CDS (1)..(639)
  misc_feature (1)..(639): V124P_A24
  misc_feature (372)..(372): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatccngggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 224 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 225 - DNA, 639 bp, Foot-and-mouth disease virus
  CDS (1)..(639)
  misc_feature (1)..(639): V124P_Asia_leb_89
  misc_feature (372)..(372): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacccngggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 226 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADPGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 227 - DNA, 639 bp, Foot-and-mouth disease virus
  CDS (1)..(639)
  misc_feature (1)..(639): V124P_Asia1_Shamir
  misc_feature (372)..(372): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacccngggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 228 - protein, 213 aa, Foot-and-mouth disease virus; identical to SEQ ID NO: 226

SEQ ID NO: 229 - DNA, 639 bp, Foot-and-mouth disease virus
  CDS (1)..(639)
  misc_feature (1)..(639): V124P_C3
  misc_feature (372)..(372): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacccngggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 230 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 231 - DNA, 639 bp, Foot-and-mouth disease virus
  CDS (1)..(639)
  misc_feature (1)..(639): V124P_O-pan_asia
  misc_feature (372)..(372): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatcccgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 232 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADPGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 233 - DNA, 639 bp, Foot-and-mouth disease virus
  CDS (1)..(639)
  misc_feature (1)..(639): V124P_01_Manissa
  misc_feature (372)..(372): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacccngggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 234 - protein, 213 aa, Foot-and-mouth disease virus; identical to SEQ ID NO: 230

SEQ ID NO: 235 - DNA, 639 bp, Foot-and-mouth disease virus
  CDS (1)..(639)
  misc_feature (1)..(639): V124P_SAT1
  misc_feature (372)..(372): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacccnggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 236 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADPGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 237 - DNA, 639 bp, Foot-and-mouth disease virus
  CDS (1)..(639)
  misc_feature (1)..(639): V124P_SAT2_Egypt_2010
  misc_feature (372)..(372): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacccngggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 238 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADPGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 239 - DNA, 639 bp, Foot-and-mouth disease virus
  CDS (1)..(639)
  misc_feature (1)..(639): V124P_SAT3
  misc_feature (372)..(372): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatccnggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 240 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADPGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 241 - DNA, 639 bp, Foot-and-mouth disease virus
  CDS (1)..(639)
  misc_feature (1)..(639): I22P/L127P_A_2006
  misc_feature (66)..(66): n is c, g, a, t/u
  misc_feature (381)..(381): n is c, g, a, t/u
agtggtgcccccccgaccgacttgcaaaagatggtcatgggcaacaccaagcctgttgagctcccnctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagaccnattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 242 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 243 - DNA, 639 bp, Foot-and-mouth disease virus
  CDS (1)..(639)
  misc_feature (1)..(639): I22P/L127P_A24
  misc_feature (66)..(66): n is c, g, a, t/u
  misc_feature (381)..(381): n is c, g, a, t/u
agtggtgccccaccgaccgacttgcaaaagttggtcatgggcaacaccaagcccgttgagctcccncttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagaccnattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 244 - protein, 213 aa, Foot-and-mouth disease virus
SGAPPTDLQKLVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 245 - DNA, 639 bp, Foot-and-mouth disease virus
  CDS (1)..(639)
  misc_feature (1)..(639): I22P/L127P_asia_leb_89
  misc_feature (66)..(66): n is c, g, a, t/u
  misc_feature (381)..(381): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccnattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 246 - protein, 213 aa, Foot-and-mouth disease virus
SGAPPTDLQKMVMSNTKPVELPLDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 247 - DNA, 639 bp, Foot-and-mouth disease virus; identical to SEQ ID NO: 245
  CDS (1)..(639)
  misc_feature (1)..(639): I22P/L127P_Asia1_Shamir
  misc_feature (66)..(66): n is c, g, a, t/u
  misc_feature (381)..(381): n is c, g, a, t/u

SEQ ID NO: 248 - protein, 213 aa, Foot-and-mouth disease virus; identical to SEQ ID NO: 246

SEQ ID NO: 249 - DNA, 639 bp, Foot-and-mouth disease virus
  CDS (1)..(639)
  misc_feature (1)..(639): I22P/L127_C3
  misc_feature (66)..(66): n is c, g, a, t/u
  misc_feature (381)..(381): n is c, g, a, t/u
agcggtgccccaccgaccgacttgcaaaagatggtcatgggcaacaccaagcctgttgagctgccnctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagaccnattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 250 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 251 - DNA, 639 bp, Foot-and-mouth disease virus
  CDS (1)..(639)
  misc_feature (1)..(639): I22P/L127P_O_pan_asia
  misc_feature (66)..(66): n is c, g, a, t/u
  misc_feature (381)..(381): n is c, g, a, t/u
agtggtgctccaccgactgacttgcaaaagatggtcatgggtaacaccaagcccgttgagctcccncttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagaccnattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 252 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 253 - DNA, 639 bp, Foot-and-mouth disease virus
  CDS (1)..(639)
  misc_feature (1)..(639): n is c, g, a, t/u
  misc_feature (66)..(66): I22P/L127P_01_Manissa
  misc_feature (381)..(381): I22P/L127P_01_Manissa
agtggtgccccaccgaccgacttgcagaagatggtcatgggcaacactaagcctgttgagctcccnctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagaccnattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 254 - protein, 213 aa, Foot-and-mouth disease virus; identical to SEQ ID NO: 250

SEQ ID NO: 255 - DNA, 639 bp, Foot-and-mouth disease virus
  CDS (1)..(639)
  misc_feature (1)..(639): I22P/L127P_SAT1
  misc_feature (66)..(66): n is c, g, a, t/u
  misc_feature (381)..(381): n is c, g, a, t/u
agcggatgtccaccgaccgacctgcagaggatggtcatggcaaacgtgaaacccgttgagctcccnctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagaccnatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 256 - protein, 213 aa, Foot-and-mouth disease virus
SGCPPTDLQRMVMANVKPVELPLDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 257 - DNA, 639 bp, Foot-and-mouth disease virus
  CDS (1)..(639)
  misc_feature (1)..(639): I22P/L127P_SAT2_Egypt_2010
  misc_feature (66)..(66): n is c, g, a, t/u
  misc_feature (381)..(381): n is c, g, a, t/u
agtggagcgccacccaccgacttgcaaaagatggtgatggccaacaccaaaccagtcgagctcccnctcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagaccnatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 258 - protein, 213 aa, Foot-and-mouth disease virus
SGAPPTDLQKMVMANTKPVELPLDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 259 - DNA, 639 bp, Foot-and-mouth disease virus
  CDS (1)..(639)
  misc_feature (1)..(639): I22P/L127_SAT3
  misc_feature (66)..(66): n is c, g, a, t/u
  misc_feature (381)..(381): n is c, g, a, t/u
agcggatgcccaccgaccgacttgcaaaagatggtcatggcaaacgtaaagcctgttgagctcccnctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagaccnatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 260 - protein, 213 aa, Foot-and-mouth disease virus
SGCPPTDLQKMVMANVKPVELPLDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 261 - DNA, 639 bp, Foot-and-mouth disease virus
  CDS (1)..(639)
  misc_feature (1)..(639): T100P/L127P_A_2006
  misc_feature (300)..(300): n is c, g, a, t/u
  misc_feature (381)..(381): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcccnaaacactttcgtgatacagcaagaatgaagaagggcacccccgttgtcggtgttatcaacaacgctgatgtcgggagaccnattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 262 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 263 - DNA, 639 bp, Foot-and-mouth disease virus
  CDS (1)..(639)
  misc_feature (1)..(639): T100P/L127P_A24
  misc_feature (300)..(300): n is c, g, a, t/u
  misc_feature (381)..(381): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcccnaaacactttcgtgacacagcaagaatgaagaaaggcacccccgtcgttggtgtgatcaacaacgccgatgtcgggagaccnattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 264 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 265 - DNA, 639 bp, Foot-and-mouth disease virus
  CDS (1)..(639)
  misc_feature (1)..(639): T100P/L127P_Asia_leb_89
  misc_feature (300)..(300): n is c, g, a, t/u
  misc_feature (381)..(381): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacgttgggagaccnattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 266 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 267 - DNA, 639 bp, Foot-and-mouth disease virus; identical to SEQ ID NO: 265
  CDS (1)..(639)
  misc_feature (1)..(639): T100P/L127P_Asia1_Shamir
  misc_feature (300)..(300): n is c, g, a, t/u
  misc_feature (381)..(381): n is c, g, a, t/u

SEQ ID NO: 268 - protein, 213 aa, Foot-and-mouth disease virus; identical to SEQ ID NO: 266

SEQ ID NO: 269 - DNA, 639 bp, Foot-and-mouth disease virus
  CDS (1)..(639)
  misc_feature (1)..(639): T100P/L127P_C3
  misc_feature (300)..(300): n is c, g, a, t/u
  misc_feature (381)..(381): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcccnaagcactttcgtgacacagcaagaatgaagaaaggcacccccgtcgtaggcgtgattaacaacgccgacgttgggagaccnattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 270 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 271 - DNA, 639 bp, Foot-and-mouth disease virus
  CDS (1)..(639)
  misc_feature (1)..(639): T100P/L127P_O_pan_asia
  misc_feature (300)..(300): n is c, g, a, t/u
  misc_feature (381)..(381): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcccnaaacacttccgtgatgtggcaagaatgaagaaaggaacccccgtcgttggtgttatcaacaacgccgatgtcgggagaccnattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 272 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDIPKHFRDVARMKKGTPVVGVINNADVGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 273 - DNA, 639 bp, Foot-and-mouth disease virus
  CDS (1)..(639)
  misc_feature (1)..(639): T100P/L127P_01_Manissa
  misc_feature (300)..(300): n is c, g, a, t/u
  misc_feature (381)..(381): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcccnaaacattttcgtgacacagcaagaatgaagaaaggcacccccgttgtcggtgtgatcaacaacgccgacgttgggagaccnattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 274 - protein, 213 aa, Foot-and-mouth disease virus; identical to SEQ ID NO: 270

SEQ ID NO: 275 - DNA, 639 bp, Foot-and-mouth disease virus
  CDS (1)..(639)
  misc_feature (1)..(639): T100P/L127P_SAT1
  misc_feature (300)..(300): n is c, g, a, t/u
  misc_feature (381)..(381): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcccnggacacttccgtgacacaatgaaactgtcgaaaggcagtcccgtcgttggtgtggtcaacaacgccgacgtcggaagaccnatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 276 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 277 - DNA, 639 bp, Foot-and-mouth disease virus
  CDS (1)..(639)
  misc_feature (1)..(639): T100P/L127P_SAT2_Egypt_2010
  misc_feature (300)..(300): n is c, g, a, t/u
  misc_feature (381)..(381): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcccnaagcactttcgtgatcaagcaagaatgagaaaaggaacccccgtggttggcgtgatcaacaacgccgacgttgggagaccnatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 278 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDIPKHFRDQARMRKGTPVVGVINNADVGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 279 - DNA, 639 bp, Foot-and-mouth disease virus
  CDS (1)..(639)
  misc_feature (1)..(639): T100P/L127P_SAT3
  misc_feature (300)..(300): n is c, g, a, t/u
  misc_feature (381)..(381): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcccnggacacttccgtgacaccatgaaactgtcgaaaggcagccccgtcgttggtgttgtcaacaacgctgatgtcggaagaccnatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 280 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 281 - DNA, 639 bp, Foot-and-mouth disease virus
  CDS (1)..(639)
  misc_feature (1)..(639): T34A/M88L_A_2006
  misc_feature (102)..(102): n is c, g, a, t/u
  misc_feature (264)..(264): n is c, g, a, t/u
agtggtgcccccccgaccgacttgcaaaagatggtcatgggcaacaccaagcctgttgagctcatcctcgacgggaagacggtagccatctgttgcgctgcnggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcctngtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 282 - protein, 213 aa, Foot-and-mouth disease virus
  misc_feature (88)..(88): The 'Xaa' at location 88 stands for Leu.
SGAPPTDLQKMVMGNTKPVELILDGKTVAICCAAGVFGTAYLVPRHLFAEKYDKIMLDGRAMTDSDYRVFEFEIKVKGQDMLSDAALXVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 283 - DNA, 639 bp, Foot-and-mouth disease virus
  CDS (1)..(639)
  misc_feature (1)..(639): T34A/M88L_24
  misc_feature (102)..(102): n is c, g, a, t/u
  misc_feature (264)..(264): n is c, g, a, t/u
agtggtgccccaccgaccgacttgcaaaagttggtcatgggcaacaccaagcccgttgagctcatccttgacgggaagacggtagccatttgctgtgctgcnggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcctngtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 284 - protein, 213 aa, Foot-and-mouth disease virus
  misc_feature (88)..(88): The 'Xaa' at location 88 stands for Leu.
SGAPPTDLQKLVMGNTKPVELILDGKTVAICCAAGVFGTAYLVPRHLFAEKYDKIMLDGRAMTDSDYRVFEFEIKVKGQDMLSDAALXVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 285 - DNA, 639 bp, Foot-and-mouth disease virus
  CDS (1)..(639)
  misc_feature (1)..(639): T34A/M88L_Asia_leb_89
  misc_feature (102)..(102): n is c, g, a, t/u
  misc_feature (264)..(264): n is c, g, a, t/u
agtggtgccccaccgaccgacttgcaaaagatggtcatgagcaacactaagcctgttgagctcatccttgacggtaagacggtggccatctgctgcgccgcnggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcctngtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 286 - protein, 213 aa, Foot-and-mouth disease virus
  misc_feature (88)..(88): The 'Xaa' at location 88 stands for Leu.
SGAPPTDLQKMVMSNTKPVELILDGKTVAICCAAGVFGTAYLVPRHLFAEKYDRIMLDGRAMTDSDYRVFEFEIKVKGQDMLSDAALXVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 287 - DNA, 639 bp, Foot-and-mouth disease virus
  CDS (1)..(639)
  misc_feature (1)..(639): T34A/M88L_Asia1_Shamir
  misc_feature (102)..(102): n is c, g, a, t/u
  misc_feature (264)..(264): n is c, g, a, t/u
agtggtgccccaccgaccgacttgcaaaagatggtcatgagcaacactaagcctgttgagctcatccttgacggtaagacggtggccatctgctgcgccgcnggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcctngtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 288 - protein, 213 aa, Foot-and-mouth disease virus; identical to SEQ ID NO: 286
  misc_feature (88)..(88): The 'Xaa' at location 88 stands for Leu.

SEQ ID NO: 289 - DNA, 639 bp, Foot-and-mouth disease virus
  CDS (1)..(639)
  misc_feature (1)..(639): T34A/M88L_C3
  misc_feature (102)..(102): n is c, g, a, t/u
  misc_feature (264)..(264): n is c, g, a, t/u
agcggtgccccaccgaccgacttgcaaaagatggtcatgggcaacaccaagcctgttgagctgattctcgatgggaagacggtggccatctgctgcgccgcnggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcctngtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 290 - protein, 213 aa, Foot-and-mouth disease virus
  misc_feature (88)..(88): The 'Xaa' at location 88 stands for Leu.
SGAPPTDLQKMVMGNTKPVELILDGKTVAICCAAGVFGTAYLVPRHLFAEKYDKIMLDGRAMTDSDYRVFEFEIKVKGQDMLSDAALXVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 291 - DNA, 639 bp, Foot-and-mouth disease virus
  CDS (1)..(639)
  misc_feature (1)..(639): T34A/M88L_O_pan_asia
  misc_feature (102)..(102): n is c, g, a, t/u
  misc_feature (264)..(264): n is c, g, a, t/u
agtggtgctccaccgactgacttgcaaaagatggtcatgggtaacaccaagcccgttgagctcatacttgacgggaagacagtagccatctgctgtgctgcnggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcctngtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 292 - protein, 213 aa, Foot-and-mouth disease virus
  misc_feature (88)..(88): The 'Xaa' at location 88 stands for Leu.
SGAPPTDLQKMVMGNTKPVELILDGKTVAICCAAGVFGTAYLVPRHLFAEKYDKIMLDGRAMTDSDYRVFEFEIKVKGQDMLSDAALXVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 293 - DNA, 639 bp, Foot-and-mouth disease virus
  CDS (1)..(639)
  misc_feature (1)..(639): T34A/M88L_01_Manissa
  misc_feature (102)..(102): n is c, g, a, t/u
  misc_feature (264)..(264): n is c, g, a, t/u
agtggtgccccaccgaccgacttgcagaagatggtcatgggcaacactaagcctgttgagctcatcctcgacgggaagacggtagccatctgctgtgctgcnggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcctngtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 294 - protein, 213 aa, Foot-and-mouth disease virus; identical to SEQ ID NO: 290
  misc_feature (88)..(88): The 'Xaa' at location 88 stands for Leu.

SEQ ID NO: 295 - DNA, 639 bp, Foot-and-mouth disease virus
  CDS (1)..(639)
  misc_feature (1)..(639): T34A/M88L_SAT1
  misc_feature (102)..(102): n is c, g, a, t/u
  misc_feature (264)..(264): n is c, g, a, t/u
agcggatgtccaccgaccgacctgcagaggatggtcatggcaaacgtgaaacccgttgagctcatcctcgatgggaagaccgttgcgctctgctgcgctgcnggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcctngttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 296 - protein, 213 aa, Foot-and-mouth disease virus
  misc_feature (88)..(88): The 'Xaa' at location 88 stands for Leu.
SGCPPTDLQRMVMANVKPVELILDGKTVALCCAAGVFGTAYLVPRHLFAEKYDKIMLDGRALTDSDFRVFEFEVKVKGQDMLSDAALXVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 297 - DNA, 639 bp, Foot-and-mouth disease virus
  CDS (1)..(639)
  misc_feature (1)..(639): T34A/M88L_SAT2_Egypt_2010
  misc_feature (102)..(102): n is c, g, a, t/u
  misc_feature (264)..(264): n is c, g, a, t/u
agtggagcgccacccaccgacttgcaaaagatggtgatggccaacaccaaaccagtcgagctcatactcgatggtaagacagtggcgatctgctgtgccgcnggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcctngtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 298 - protein, 213 aa, Foot-and-mouth disease virus
  misc_feature (88)..(88): The 'Xaa' at location 88 stands for Leu.
SGAPPTDLQKMVMANTKPVELILDGKTVAICCAAGVFGTAYLVPRHLFAEKYDKIMIDGRAMTDRDFRVFEFEIKVKGQDMLSDAALXVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 299 - DNA, 639 bp, Foot-and-mouth disease virus
  CDS (1)..(639)
  misc_feature (1)..(639): T34A/M88L_SAT3
  misc_feature (102)..(102): n is c, g, a, t/u
  misc_feature (264)..(264): n is c, g, a, t/u
agcggatgcccaccgaccgacttgcaaaagatggtcatggcaaacgtaaagcctgttgagctcatcctcgacgggaagaccgttgcgctctgctgcgcggcnggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcctngttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 300 - protein, 213 aa, Foot-and-mouth disease virus
  misc_feature (88)..(88): The 'Xaa' at location 88 stands for Leu.
SGCPPTDLQKMVMANVKPVELILDGKTVALCCAAGVFGTAYLVPRHLFAEKYDKIMLDGRALTDSDFRVFEFEVKVKGQDMLSDAALXVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 301 - DNA, 639 bp, Foot-and-mouth disease virus
  CDS (1)..(639)
  misc_feature (1)..(639): V124P/L127P_A_2006
  misc_feature (372)..(372): n is c, g, a, t/u
  misc_feature (381)..(381): n is c, g, a, t/u
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatccngggagaccnattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 302 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 303 - DNA, 639 bp, Foot-and-mouth disease virus
  CDS (1)..(639)
  misc_feature (1)..(639): V124P/L127P_A24
  misc_feature (372)..(372): n is c, g, a, t/u
  misc_feature (381)..(381): n is c, g, a, t/u
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatccngggagaccnattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 304 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 305 - DNA, 639 bp, Foot-and-mouth disease virus
  CDS (1)..(639)
  misc_feature (1)..(639): V124P/L127P_Asia_leb_89
  misc_feature (372)..(372): n is c, g, a, t/u
  misc_feature (381)..(381): n is c, g, a, t/u
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacccngggagaccnattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 306 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADPGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 307 - DNA, 639 bp, Foot-and-mouth disease virus; identical to SEQ ID NO: 305
  CDS (1)..(639)
  misc_feature (1)..(639): V124P/L127P_Asia1_Shamir
  misc_feature (372)..(372): n is c, g, a, t/u
  misc_feature (381)..(381): n is c, g, a, t/u

SEQ ID NO: 308 - protein, 213 aa, Foot-and-mouth disease virus; identical to SEQ ID NO: 306

SEQ ID NO: 309 - DNA, 639 bp, Foot-and-mouth disease virus
  CDS (1)..(639)
  misc_feature (1)..(639): V124P/L127P_C3
  misc_feature (372)..(372): n is c, g, a, t/u
  misc_feature (381)..(381): n is c, g, a, t/u
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacccngggagaccnattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 310 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADPGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 311 - DNA, 639 bp, Foot-and-mouth disease virus
  CDS (1)..(639)
  misc_feature (1)..(639): V124P/L127P_O_pan_asia
  misc_feature (372)..(372): n is c, g, a, t/u
  misc_feature (381)..(381): n is c, g, a, t/u
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatccngggagaccnattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 312 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADPGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 313 - DNA, 639 bp, Foot-and-mouth disease virus
  CDS (1)..(639)
  misc_feature (1)..(639): V124P/L127P_01_Manissa
  misc_feature (372)..(372): n is c, g, a, t/u
  misc_feature (381)..(381): n is c, g, a, t/u
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacccngggagaccnattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 314 - protein, 213 aa, Foot-and-mouth disease virus; identical to SEQ ID NO: 310

SEQ ID NO: 315 - DNA, 639 bp, Foot-and-mouth disease virus
  CDS (1)..(639)
  misc_feature (1)..(639): V124P/L127P_SAT1
  misc_feature (372)..(372): n is c, g, a, t/u
  misc_feature (381)..(381): n is c, g, a, t/u
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacccnggaagaccnatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 316 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADPGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 317 - DNA, 639 bp, Foot-and-mouth disease virus
  CDS (1)..(639)
  misc_feature (1)..(639): V124P/L127P_SAT2_Egypt_2010
  misc_feature (372)..(372): n is c, g, a, t/u
  misc_feature (381)..(381): n is c, g, a, t/u
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacccngggagaccnatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 318 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADPGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 319 - DNA, 639 bp, Foot-and-mouth disease virus
  CDS (1)..(639)
  misc_feature (1)..(639): V124P/L127P_SAT3
  misc_feature (372)..(372): n is c, g, a, t/u
  misc_feature (381)..(381): n is c, g, a, t/u
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatccnggaagaccnatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 320 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADPGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 321 - DNA, 639 bp, Foot-and-mouth disease virus
  CDS (1)..(639)
  misc_feature (1)..(639): I22P/T100P/L127P_A_2006
  misc_feature (66)..(66): n is c, g, a, t/u
  misc_feature (300)..(300): n is c, g, a, t/u
  misc_feature (381)..(381): n is c, g, a, t/u
agtggtgcccccccgaccgacttgcaaaagatggtcatgggcaacaccaagcctgttgagctcccnctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcccnaaacactttcgtgatacagcaagaatgaagaagggcacccccgttgtcggtgttatcaacaacgctgatgtcgggagaccnattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 322 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 323 - DNA, 639 bp, Foot-and-mouth disease virus
  CDS (1)..(639)
  misc_feature (1)..(639): I22P/T100P/L127P_A24
  misc_feature (66)..(66): n is c, g, a, t/u
  misc_feature (300)..(300): n is c, g, a, t/u
  misc_feature (381)..(381): n is c, g, a, t/u
agtggtgccccaccgaccgacttgcaaaagttggtcatgggcaacaccaagcccgttgagctcccncttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcccnaaacactttcgtgacacagcaagaatgaagaaaggcacccccgtcgttggtgtgatcaacaacgccgatgtcgggagaccnattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 324 - protein, 213 aa, Foot-and-mouth disease virus
SGAPPTDLQKLVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 325 - DNA, 639 bp, Foot-and-mouth disease virus
  CDS (1)..(639)
  misc_feature (1)..(639): I22P/T100P/L127P_Asia_leb_89
  misc_feature (66)..(66): n is c, g, a, t/u
  misc_feature (300)..(300): n is c, g, a, t/u
  misc_feature (381)..(381): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacgttgggagaccnattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 326 - protein, 213 aa, Foot-and-mouth disease virus
SGAPPTDLQKMVMSNTKPVELPLDGKTVAICCATGVFGTAYLVPRHLFAEKYDRIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 327 - DNA, 639 bp, Foot-and-mouth disease virus; identical to SEQ ID NO: 325
  CDS (1)..(639)
  misc_feature (1)..(639): I22P/T100P/L127P_Asia1_Shamir
  misc_feature (66)..(66): n is c, g, a, t/u
  misc_feature (300)..(300): n is c, g, a, t/u
  misc_feature (381)..(381): n is c, g, a, t/u

SEQ ID NO: 328 - protein, 213 aa, Foot-and-mouth disease virus; identical to SEQ ID NO: 326

SEQ ID NO: 329 - DNA, 639 bp, Foot-and-mouth disease virus
  CDS (1)..(639)
  misc_feature (1)..(639): I22P/T100P/L127P_C3
  misc_feature (66)..(66): n is c, g, a, t/u
  misc_feature (300)..(300): n is c, g, a, t/u
  misc_feature (381)..(381): n is c, g, a, t/u
agcggtgccccaccgaccgacttgcaaaagatggtcatgggcaacaccaagcctgttgagctgccnctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcccnaagcactttcgtgacacagcaagaatgaagaaaggcacccccgtcgtaggcgtgattaacaacgccgacgttgggagaccnattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 330 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 331 - DNA, 639 bp, Foot-and-mouth disease virus
  CDS (1)..(639)
  misc_feature (1)..(639): I22P/T100P/L127P_O_pan_asia
  misc_feature (66)..(66): n is c, g, a, t/u
  misc_feature (300)..(300): n is c, g, a, t/u
  misc_feature (381)..(381): n is c, g, a, t/u
agtggtgctccaccgactgacttgcaaaagatggtcatgggtaacaccaagcccgttgagctcccncttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcccnaaacacttccgtgatgtggcaagaatgaagaaaggaacccccgtcgttggtgttatcaacaacgccgatgtcgggagaccnattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 332 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDVARMKKGTPVVGVINNADVGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 333 - DNA, 639 bp, Foot-and-mouth disease virus
  CDS (1)..(639)
  misc_feature (1)..(639): I22P/T100P/L127P_)1_Manissa
  misc_feature (66)..(66): n is c, g, a, t/u
  misc_feature (300)..(300): n is c, g, a, t/u
  misc_feature (381)..(381): n is c, g, a, t/u
agtggtgccccaccgaccgacttgcagaagatggtcatgggcaacactaagcctgttgagctcccnctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcccnaaacattttcgtgacacagcaagaatgaagaaaggcacccccgttgtcggtgtgatcaacaacgccgacgttgggagaccnattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 334 - protein, 213 aa, Foot-and-mouth disease virus; identical to SEQ ID NO: 330

SEQ ID NO: 335 - DNA, 639 bp, Foot-and-mouth disease virus
  CDS (1)..(639)
  misc_feature (1)..(639): I22P/T100P/L127P_SAT1
  misc_feature (66)..(66): n is c, g, a, t/u
  misc_feature (300)..(300): n is c, g, a, t/u
  misc_feature (381)..(381): n is c, g, a, t/u
agcggatgtccaccgaccgacctgcagaggatggtcatggcaaacgtgaaacccgttgagctcccnctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcccnggacacttccgtgacacaatgaaactgtcgaaaggcagtcccgtcgttggtgtggtcaacaacgccgacgtcggaagaccnatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 336 - protein, 213 aa, Foot-and-mouth disease virus
SGCPPTDLQRMVMANVKPVELPLDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 337 - DNA, 639 bp, Foot-and-mouth disease virus
  CDS (1)..(639)
  misc_feature (1)..(639): I22P/T100P/L127P_SAT2_Egypt_2010
  misc_feature (66)..(66): n is c, g, a, t/u
  misc_feature (300)..(300): n is c, g, a, t/u
  misc_feature (381)..(381): n is c, g, a, t/u
agtggagcgccacccaccgacttgcaaaagatggtgatggccaacaccaaaccagtcgagctcccnctcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcccnaagcactttcgtgatcaagcaagaatgagaaaaggaacccccgtggttggcgtgatcaacaacgccgacgttgggagaccnatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 338 - protein, 213 aa, Foot-and-mouth disease virus
SGAPPTDLQKMVMANTKPVELPLDGKTVAICCATGVFGTAYLVPRHLFAEKYDKIMIDGRAMTDRDFRVFEFEIKVKGQDMLSDAALMVLHRGNRVRDIPKHFRDQARMRKGTPVVGVINNADVGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 339 - DNA, 639 bp, Foot-and-mouth disease virus
  CDS (1)..(639)
  misc_feature (1)..(639): I22P/T100P/L127P_SAT3
  misc_feature (66)..(66): n is c, g, a, t/u
  misc_feature (300)..(300): n is c, g, a, t/u
  misc_feature (381)..(381): n is c, g, a, t/u
agcggatgcccaccgaccgacttgcaaaagatggtcatggcaaacgtaaagcctgttgagctcccnctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcccnggacacttccgtgacaccatgaaactgtcgaaaggcagccccgtcgttggtgttgtcaacaacgctgatgtcggaagaccnatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 340 - protein, 213 aa, Foot-and-mouth disease virus
SGCPPTDLQKMVMANVKPVELPLDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 341 - DNA, 639 bp, Foot-and-mouth disease virus
  CDS (1)..(639)
  misc_feature (1)..(639): I22P/T100P/V124P_A_2006
  misc_feature (66)..(66): n is c, g, a, t/u
  misc_feature (300)..(300): n is c, g, a, t/u
  misc_feature (372)..(372): n is c, g, a, t/u
agtggtgcccccccgaccgacttgcaaaagatggtcatgggcaacaccaagcctgttgagctcccnctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcccnaaacactttcgtgatacagcaagaatgaagaagggcacccccgttgtcggtgttatcaacaacgctgatccngggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 342 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADPGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 343 - DNA, 639 bp, Foot-and-mouth disease virus
  CDS (1)..(639)
  misc_feature (1)..(639): I22P/T100P/V124P_A24
  misc_feature (66)..(66): n is c, g, a, t/u
  misc_feature (300)..(300): n is c, g, a, t/u
  misc_feature (372)..(372): n is c, g, a, t/u
agtggtgccccaccgaccgacttgcaaaagttggtcatgggcaacaccaagcccgttgagctcccncttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcccnaaacactttcgtgacacagcaagaatgaagaaaggcacccccgtcgttggtgtgatcaacaacgccgatccngggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 344 - protein, 213 aa, Foot-and-mouth disease virus
SGAPPTDLQKLVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADPGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 345 - DNA, 639 bp, Foot-and-mouth disease virus
  CDS (1)..(639)
  misc_feature (1)..(639): I22P/T100P/V124P_Asia_leb_89
  misc_feature (66)..(66): n is c, g, a, t/u
  misc_feature (300)..(300): n is c, g, a, t/u
  misc_feature (372)..(372): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacccngggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 346 - protein, 213 aa, Foot-and-mouth disease virus
SGAPPTDLQKMVMSNTKPVELPLDGKTVAICCATGVFGTAYLVPRHLFAEKYDRIMLDGRAMTDSDYRVFEFEIKVKGQDMLSDAALMVLHRGNRVRDIPKHFRDTARMKKGTPVVGVINNADPGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 347 - DNA, 639 bp, Foot-and-mouth disease virus
  misc_feature (1)..(639): I22P/T100P/V124P_Asia1_Shamir
  CDS (1)..(639)
  misc_feature (66)..(66): n is c, g, a, t/u
  misc_feature (300)..(300): n is c, g, a, t/u
  misc_feature (372)..(372): n is c, g, a, t/u
agtggtgccccaccgaccgacttgcaaaagatggtcatgagcaacactaagcctgttgagctcccncttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccnaaacactttcgtgatacagcaagaatgaagaaaggtacccccgttgtcggcgtgatcaacaacgccgacccngggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 348 - protein, 213 aa, Foot-and-mouth disease virus; identical to SEQ ID NO: 346

SEQ ID NO: 349 - DNA, 639 bp, Foot-and-mouth disease virus
  CDS (1)..(639)
  misc_feature (1)..(639): I22/T100P/V124P_C3
  misc_feature (66)..(66): n is c, g, a, t/u
  misc_feature (300)..(300): n is c, g, a, t/u
  misc_feature (372)..(372): n is c, g, a, t/u
agcggtgccccaccgaccgacttgcaaaagatggtcatgggcaacaccaagcctgttgagctgccnctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcccnaagcactttcgtgacacagcaagaatgaagaaaggcacccccgtcgtaggcgtgattaacaacgccgacccngggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 350 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDTARMKKGTPVVGVINNADPGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 351 - DNA, 639 bp, Foot-and-mouth disease virus
  CDS (1)..(639)
  misc_feature (1)..(639): I22P/T100P/124P_O_pan_asia
  misc_feature (66)..(66): n is c, g, a, t/u
  misc_feature (300)..(300): n is c, g, a, t/u
  misc_feature (372)..(372): n is c, g, a, t/u
agtggtgctccaccgactgacttgcaaaagatggtcatgggtaacaccaagcccgttgagctcccncttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcccnaaacacttccgtgatgtggcaagaatgaagaaaggaacccccgtcgttggtgttatcaacaacgccgatccngggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 352 - protein, 213 aa, Foot-and-mouth disease virus
SGAPPTDLQKMVMGNTKPVELPLDGKTVAICCATGVFGTAYLVPRHLFAEKYDKIMLDGRAMTDSDYRVFEFEIKVKGQDMLSDAALMVLHRGNRVRDIPKHFRDVARMKKGTPVVGVINNADPGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 353 - DNA, 639 bp, Foot-and-mouth disease virus
  CDS (1)..(639)
  misc_feature (1)..(639): I22P/T100P/V124P_01_Manissaa
  misc_feature (66)..(66): n is c, g, a, t/u
  misc_feature (300)..(300): n is c, g, a, t/u
  misc_feature (372)..(372): n is c, g, a, t/u
agtggtgccccaccgaccgacttgcagaagatggtcatgggcaacactaagcctgttgagctcccnctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcccnaaacattttcgtgacacagcaagaatgaagaaaggcacccccgttgtcggtgtgatcaacaacgccgacccngggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 354 - protein, 213 aa, Foot-and-mouth disease virus; identical to SEQ ID NO: 350

SEQ ID NO: 355 - DNA, 639 bp, Foot-and-mouth disease virus
  CDS (1)..(639)
  misc_feature (1)..(639): I22P/T100P/V124P_SAT1
  misc_feature (66)..(66): n is c, g, a, t/u
  misc_feature (300)..(300): n is c, g, a, t/u
  misc_feature (372)..(372): n is c, g, a, t/u
agcggatgtccaccgaccgacctgcagaggatggtcatggcaaacgtgaaacccgttgagctcccnctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcccnggacacttccgtgacacaatgaaactgtcgaaaggcagtcccgtcgttggtgtggtcaacaacgccgacccnggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 356 - protein, 213 aa, Foot-and-mouth disease virus
SGCPPTDLQRMVMANVKPVELPLDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADPGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 357 - DNA, 639 bp, Foot-and-mouth disease virus
  CDS (1)..(639)
  misc_feature (1)..(639): I22P/T100P/V124P_SAT_Egypt_2010
  misc_feature (66)..(66): n is c, g, a, t/u
  misc_feature (300)..(300): n is c, g, a, t/u
  misc_feature (372)..(372): n is c, g, a, t/u
agtggagcgccacccaccgacttgcaaaagatggtgatggccaacaccaaaccagtcgagctcccnctcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcccnaagcactttcgtgatcaagcaagaatgagaaaaggaacccccgtggttggcgtgatcaacaacgccgacccngggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 358 - protein, 213 aa, Foot-and-mouth disease virus
SGAPPTDLQKMVMANTKPVELPLDGKTVAICCATGVFGTAYLVPRHLFAEKYDKIMIDGRAMTDRDFRVFEFEIKVKGQDMLSDAALMVLHRGNRVRDIPKHFRDQARMRKGTPVVGVINNADPGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 359 - DNA, 639 bp, Foot-and-mouth disease virus
  CDS (1)..(639)
  misc_feature (1)..(639): I22P/T100P/V124P_SAT3
  misc_feature (66)..(66): n is c, g, a, t/u
  misc_feature (300)..(300): n is c, g, a, t/u
  misc_feature (372)..(372): n is c, g, a, t/u
agcggatgcccaccgaccgacttgcaaaagatggtcatggcaaacgtaaagcctgttgagctcccnctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcccnggacacttccgtgacaccatgaaactgtcgaaaggcagccccgtcgttggtgttgtcaacaacgctgatccnggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 360 - protein, 213 aa, Foot-and-mouth disease virus
SGCPPTDLQKMVMANVKPVELPLDGKTVALCCATGVFGTAYLVPRHLFAEKYDKIMLDGRALTDSDFRVFEFEVKVKGQDMLSDAALMVLHSGNRVRDLPGHFRDTMKLSKGSPVVGVVNNADPGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 361 - DNA, 2262 bp, Artificial Sequence
  P1_A2006_cut_sites_removed
ggagccgggcaatccagtccggcaaccgggtcacaaaaccaatcaggcaacactggtagtatcatcaacaactactacatgcagcagtaccagaactccatggatacacaacttggcgacaacgccattagcggtggttccaacgagggctccactgacactacctccacacacacaaccaacacacagaacaatgactggttttcaaagctggccagttctgccttcagcggtctcttcggcgctcttctcgctgacaaaaagacagaggagactaccctcctggaagaccgcatccttaccacccgcaacggacacaccacctcgacaacccagtcgagtgtgggtgtcacctacgggtactccactggtgaagaccacgtctctggacctaacacatctggcctggagacgcgagtggtacaggcagagagattcttcaagaaacacttgtttgattggacaactgataaggcttttggacacctggaaaaactggaactccccaccgaacacaagggtgtctatgggcacttggtggactctttcgcatacatgagaaatggctgggacgtggaggtgacagccgttggcaatcagttcaacggtgggtgtctcctggtggccatggttcctgagtggaaagagtttacccctcgtgagaaataccagctcaccctgtttccacaccaatttatcaaccccagaaccaacatgacagcccacatcacggtcccgtaccttggtgtcaataggtatgaccagtacaaacagcacaaaccctggacactggtcgtgatggtggtttcgccactgaccaccagcagcattggggcctcacagattaaggtctatgccaacattgccccaaccttcgttcacgtggccggcgagctcccatcgaaagaagggatcgtgccggttgcttgtacagacgggtacggtggcctggtgacaacagacccgaaaacagctgaccctgtttatggtatggtgtacaacccgcccagaaccaactaccctgggcgctttacaaacttgttggacgtggccgaggcttgcccgaccttcctctgttttgacgacgggaaaccttacgttgtgacaaggacggacgaccaacgcctcctggccaagtttgacgtttctcttgctgcaaagcacatgtcaaacacctacctctcagggatagcacagtactacacgcagtactctggcactatcaatctgcatttcatgttcactggctctactgaatcaaaggcccggtacatggtggcgtacattccacctggcatggacaacccaccggacacacctgagaaggctgcacactgcatccacgccgagtgggacaccgggctgaactccaaatttactttttctatcccttacgtgtctgctgcagactacgcatacactgcgtctgacgtggcagaaacaacaaacgtacaggggtgggtctgcatataccaaatcactcacgggaaggctgaacaggacactctggtcgtgtcggtcagcgccggcaaggactttgaactgcgcctcccaattgacccccgcacgcaaaccaccactgccggggagtcagcagaccctgtcaccaccaccgttgagaactacggtggtgagacacaggctcagcgacgtcagcacactgacgtcggcttcatcatggacaggtttgcgaaaatcagccccgtgagccccacgcacgtcattgacctcatgcaaacacaccaacatgcgttggtgggtgcccttttgcgtgcagccacgtactacttctccgatctggagattgtggtgcgtcatgatggcaacttgacgtgggtgcccaatggagcacctgtagaagccttggccaacacaagcaaccccaccgcctaccacaagcagccatttacgagacttgcgctcccttacaccgcgccgcaccgagtgttggcaacagtgtataacggagtaagcaagtactctacaactggtaatggcagaaggggtgatctggggcctcttgcggcgcgggtcgccgcacagctccccagctctttcaattttggtgcaattcgggccacgaccgtccacgagcttctcgtgcgcatgaaacgtgccgagctctactgtccaaggcctctgctggcagtggaagtgttgtcgcaggacagacacaagcaaaagatcattgcacctgcaaagcaactcctgaacttcgacctgctcaagttggcgggagacgttgagtccaaccccgggccc

SEQ ID NO: 362 - DNA, 2262 bp, Foot-and-mouth disease virus
  CDS (1)..(2262)
  misc_feature (1)..(2262): P1_A2006_wildtype
ggagccgggcaatccagtccggcaaccgggtcacaaaaccaatcaggcaacactggtagtatcatcaacaactactacatgcagcagtaccagaactccatggatacacaacttggcgacaacgccattagcggtggttccaacgagggctccactgacactacctccacacacacaaccaacacacagaacaatgactggttttcaaagctggccagttctgccttcagcggtctcttcggcgctcttctcgctgacaaaaagacagaggagactaccctcctggaggaccgcatccttaccacccgcaacggacacaccacctcgacaacccagtcgagtgtgggtgtcacctacgggtactccactggtgaagaccacgtctctggacctaacacatctggcctggagacgcgagtggtacaggcagagagattcttcaagaaacacttgtttgattggacaactgataaagcttttggacacctggaaaaactggaactccccaccgaacacaagggtgtctacgggcacttggtggactctttcgcatacatgagaaatggctgggacgtggaggtgaccgccgttggcaaccagttcaacggtgggtgtctcctggtggccatggtacctgagtggaaagagtttacccctcgtgagaaataccagctcaccctgtttccacaccaatttatcaaccccagaaccaacatgacagcccacatcacggtcccgtaccttggtgtcaataggtatgaccagtacaaacagcacaaaccctggacactggtcgtgatggtggtttcgccactgaccaccagcagcattggggcctcacagattaaggtctacgccaacattgccccaaccttcgttcacgtggccggcgagctcccatcgaaagaagggatcgtgccggttgcttgtacagacgggtacggtggcctggtgacaacagacccgaaaacagctgaccctgtttatggtatggtgtacaacccgcccagaaccaactaccctgggcgctttacaaacttgttggacgtggccgaggcttgcccgaccttcctctgttttgacgacgggaaaccgtacgttgtgacaaggacggacgaccaacgcctcctggccaagtttgacgtttctcttgctgcaaagcacatgtcaaacacctacctctcagggatagcacagtactacacgcagtactctggcactatcaatctgcatttcatgttcactggctctactgaatcaaaggcccggtacatggtggcgtacattccacctggcatggacaacccaccggacacacctgagaaggctgcacactgcatccacgccgagtgggacaccgggctgaactccaaatttactttttctatcccgtacgtgtctgctgcagactacgcatacactgcgtctgacgtggcagaaacaacaaacgtacaggggtgggtctgcatataccaaatcactcacgggaaggctgaacaggacactctggtcgtgtcggtcagcgccggcaaggactttgaactgcgcctcccaattgacccccgcacgcaaaccaccactgccggggagtcagcagaccctgtcaccaccaccgttgagaactacggtggtgagacacaggctcagcgacgtcagcacactgacgtcggcttcatcatggacaggtttgcgaaaatcagccccgtgagccccacgcacgtcattgacctcatgcaaacacaccaacacgcgttggtgggtgcccttttgcgtgcagccacgtactacttctccgatctggagattgtggtgcgtcatgatggcaacttgacgtgggtgcccaatggagcacctgtagaagccttggccaacacaagcaaccccaccgcctaccacaagcagccatttacgagacttgcgctcccttacaccgcgccgcaccgagtgttggcaacagtgtataacggagtaagcaagtactctacaactggtaatggcagaaggggtgacctggggcctcttgcggcgcgggtcgccgcacagctccccagctctttcaattttggtgcaattcgggccacgaccgtccacgagcttctcgtgcgcatgaaacgtgccgagctctactgtcccaggcctctgctggcagtggaagtgttgtcgcaggacagacacaagcaaaagatcattgcacctgcaaagcaactcctgaacttcgacctgctcaagttggcgggagacgttgagtccaaccctgggccc

SEQ ID NO: 363 - protein, 754 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYSTGEDHVSGPNTSGLETRVVQAERFFKKHLFDWTTDKAFGHLEKLELPTEHKGVYGHLVDSFAYMRNGWDVEVTAVGNQFNGGCLLVAMVPEWKEFTPREKYQLTLFPHQFINPRTNMTAHITVPYLGVNRYDQYKQHKPWTLVVMVVSPLTTSSIGASQIKVYANIAPTFVHVAGELPSKEGIVPVACTDGYGGLVTTDPKTADPVYGMVYNPPRTNYPGRFTNLLDVAEACPTFLCFDDGKPYVVTRTDDQRLLAKFDVSLAAKHMSNTYLSGIAQYYTQYSGTINLHFMFTGSTESKARYMVAYIPPGMDNPPDTPEKAAHCIHAEWDTGLNSKFTFSIPYVSAADYAYTASDVAETTNVQGWVCIYQITHGKAEQDTLVVSVSAGKDFELRLPIDPRTQTTTAGESADPVTTTVENYGGETQAQRRQHTDVGFIMDRFAKISPVSPTHVIDLMQTHQHALVGALLRAATYYFSDLEIVVRHDGNLTWVPNGAPVEALANTSNPTAYHKQPFTRLALPYTAPHRVLATVYNGVSKYSTTGNGRRGDLGPLAARVAAQLPSSFNFGAIRATTVHELLVRMKRAELYCPRPLLAVEVLSQDRHKQKIIAPAKQLLNFDLLKLAGDVESNPGP

SEQ ID NO: 364 - DNA, 2262 bp, Artificial Sequence
  P1_A24_Cruzeiro_cut_sites_removed
ggggccgggcaatccagtccggcgaccggctcgcagaaccaatctggcaacactggcagcataattaacaactactacatgcagcaataccagaactccatggacacacagttgggagacaatgccatcagtggaggctccaacgagggctccacggacacaacttcaacacacacaaccaacactcaaaacaatgactggttctcgaagctcgccagttcagcttttacaggtctgttcggtgcactgctcgccgacaagaagacagaggaaacgacacttcttgaggaccgcatcctcaccacccgcaacgggcacaccacctcgacgacccaatcgagtgtgggtgtcacacacgggtactccacagaggaggaccacgttgctgggccaaacacatcgggcctggagacgcgagtggtgcaggcagagagattctacaaaaagtacttgtttgactggacaacggacaaggcatttggacacctggaaaagctggagctcccgtccgaccaccacggtgtctttggacacttggtggactcgtacgcctatatgagaaatggctgggatgttgaggtgtccgctgttggcaaccagttcaacggcgggtgcctcctggtggccatggttcctgaatggaaggaatttgacacacgggagaaataccaactcacccttttcccgcaccagtttattagccccagaactaacatgactgcccacatcacggtcccctaccttggtgtgaacaggtatgatcagtacaagaagcataagccctggacattggttgtcatggtcgtgtcgccacttacggtcaacaacaccagtgcggcacaaatcaaggtctatgccaacatagctccgacctatgttcacgtggccggtgaactcccctcgaaagaggggattttcccggttgcatgtgcggacggttacggaggattggtgacgacagacccgaagacagctgaccctgcttatggcaaggtgtacaacccgcctaggactaactaccctgggcgcttcaccaacctgttggacgtggccgaagcgtgtcccactttcctctgctttgacgacgggaaaccgtacgtcaccacgcggacggatgacacccgacttttggccaagtttgacctttcccttgccgcaaaacacatgtccaacacatacctgtcagggattgctcagtactacacacagtactctggcaccatcaatttgcatttcatgttcacaggttccactgattcaaaggcccgatacatggtggcctacatcccacctggggtggagacaccaccggacacacctgaaagggctgcccactgcattcacgctgaatgggacactggactaaactccaaattcactttctcaatcccgtacgtatccgccgccgattatgcgtacacagcgtctgacacggcagaaacaatcaacgtacagggatgggtctgcatctaccaaattacacacgggaaggctgaaaatgacaccttggtcgtgtcggttagcgccggcaaagactttgagttgcgcctcccgattgacccccgccagcagaccaccgctaccggggaatcagcagacccggtcacaaccaccgtggagaactacggcggtgagacacaaatccagagacgtcaccacacggacattggtttcatcatggacagatttgtgaagatccagagcttgagcccaacacatgtcattgacctcatgcagactcaccaacacggtctggtgggtgccttgctgcgtgcagccacgtactacttttctgacctggaaattgttgtacggcacgaaggcaatctgacctgggtgcccaacggcgcccctgaatcagccctgttgaacaccagcaaccccactgcctacaacaaggcaccattcacgagactcgctctcccctacactgcgccgcaccgtgtgctggcaacagtgtacaacgggacgagtaagtatgctgtgggtggttcaggcagaagaggcgacatggggtctctcgcggcgcgagtcgtgaaacagcttcctgcttcatttaactacggtgcaatcaaggccgacgccatccacgaacttctcgtgcgcatgaaacgggccgagctctactgccccagaccgctgttggcaatagaggtgtcttcgcaagacaggcacaagcaaaagatcattgcaccagcaaagcagcttctgaattttgacctgctcaagttggccggagacgttgagtccaaccctgggccc

SEQ ID NO: 365 - DNA, 2262 bp, Foot-and-mouth disease virus
  CDS (1)..(2262)
  misc_feature (1)..(2262): P1_A24_Cruzeiro_wild_type
ggggccgggcaatccagtccggcgaccggctcgcagaaccaatctggcaacactggcagcataattaacaactactacatgcagcaataccagaactccatggacacacagttgggagacaatgccatcagtggaggctccaacgagggctccacggacacaacttcaacacacacaaccaacactcaaaacaatgactggttctcgaagctcgccagttcagcttttaccggtctgttcggtgcactgctcgccgacaagaagacagaggaaacgacacttcttgaggaccgcatcctcaccacccgcaacgggcacaccacctcgacgacccaatcgagtgtgggtgtcacacacgggtactccacagaggaggaccacgttgctgggcccaacacatcgggcctggagacgcgagtggtgcaggcagagagattctacaaaaagtacttgtttgactggacaacggacaaggcatttggacacctggaaaagctggagctcccgtccgaccaccacggtgtctttggacacttggtggactcgtacgcctatatgagaaatggctgggatgttgaggtgtccgctgttggcaaccagttcaacggcgggtgcctcctggtggccatggtacctgaatggaaggaatttgacacacgggagaaataccaactcacccttttcccgcaccagtttattagccccagaactaacatgactgcccacatcacggtcccctaccttggtgtgaacaggtatgatcagtacaagaagcataagccctggacattggttgtcatggtcgtgtcgccacttacggtcaacaacactagtgcggcacaaatcaaggtctacgccaacatagctccgacctatgttcacgtggccggtgaactcccctcgaaagaggggattttcccggttgcatgtgcggacggttacggaggattggtgacgacagacccgaagacagctgaccctgcttatggcaaggtgtacaacccgcctaggactaactaccctgggcgcttcaccaacctgttggacgtggccgaagcgtgtcccactttcctctgctttgacgacgggaaaccgtacgtcaccacgcggacggatgacacccgacttttggccaagtttgacctttcccttgccgcaaaacatatgtccaacacatacctgtcagggattgctcagtactacacacagtactctggcaccatcaatttgcatttcatgttcacaggttccactgattcaaaggcccgatacatggtggcctacatcccacctggggtggagacaccaccggacacacctgaaagggctgcccactgcattcacgctgaatgggacactggactaaactccaaattcactttctcaatcccgtacgtatccgccgcggattacgcgtacacagcgtctgacacggcagaaacaatcaacgtacagggatgggtctgcatctaccaaattacacacgggaaggctgaaaatgacaccttggtcgtgtcggttagcgccggcaaagactttgagttgcgcctcccgattgacccccgccagcagaccaccgctaccggggaatcagcagacccggtcaccaccaccgtggagaactacggcggtgagacacaaatccagagacgtcaccacacggacattggtttcatcatggacagatttgtgaagatccaaagcttgagcccaacacatgtcattgacctcatgcagactcaccaacacggtctggtgggtgccttgctgcgtgcagccacgtactacttttctgacctggaaattgttgtacggcacgaaggcaatctgacctgggtgcccaacggcgcccctgaatcagccctgttgaacaccagcaaccccactgcctacaacaaggcaccattcacgagactcgctctcccctacactgcgccgcaccgtgtgctggcaacagtgtacaacgggacgagtaagtatgctgtgggtggttcaggcagaagaggcgacatggggtctctcgcggcgcgagtcgtgaaacagcttcctgcttcatttaactacggtgcaatcaaggccgacgccatccacgaacttctcgtgcgcatgaaacgggccgagctctactgccccagaccgctgttggcaatagaggtgtcttcgcaagacaggcacaagcaaaagatcattgcaccagcaaagcagcttctgaattttgacctgctcaagttggccggagacgttgagtccaaccctgggccc

SEQ ID NO: 366 - protein, 754 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFTGLFGALLADKKTEETTLLEDRILTTRNGHTTSTTQSSVGVTHGYSTEEDHVAGPNTSGLETRVVQAERFYKKYLFDWTTDKAFGHLEKLELPSDHHGVFGHLVDSYAYMRNGWDVEVSAVGNQFNGGCLLVAMVPEWKEFDTREKYQLTLFPHQFISPRTNMTAHITVPYLGVNRYDQYKKHKPWTLVVMVVSPLTVNNTSAAQIKVYANIAPTYVHVAGELPSKEGIFPVACADGYGGLVTTDPKTADPAYGKVYNPPRTNYPGRFTNLLDVAEACPTFLCFDDGKPYVTTRTDDTRLLAKFDLSLAAKHMSNTYLSGIAQYYTQYSGTINLHFMFTGSTDSKARYMVAYIPPGVETPPDTPERAAHCIHAEWDTGLNSKFTFSIPYVSAADYAYTASDTAETINVQGWVCIYQITHGKAENDTLVVSVSAGKDFELRLPIDPRQQTTATGESADPVTTTVENYGGETQIQRRHHTDIGFIMDRFVKIQSLSPTHVIDLMQTHQHGLVGALLRAATYYFSDLEIVVRHEGNLTWVPNGAPESALLNTSNPTAYNKAPFTRLALPYTAPHRVLATVYNGTSKYAVGGSGRRGDMGSLAARVVKQLPASFNYGAIKADAIHELLVRMKRAELYCPRPLLAIEVSSQDRHKQKIIAPAKQLLNFDLLKLAGDVESNPGP

SEQ ID NO: 367 - DNA, 2249 bp, Artificial Sequence
  P1_Asia1_Shamir_cut_sites_removed
ggagccggtcaatccagtccggcaaccgggtcacagaaccaatctggcaacactggaagcatcattaacaactactacatgcaacagtaccagaactcaatggacacacagcttggtgacaacgctattagcggaggttccaacgaaggttccacggataccacttccacacacacaaacaacacccaaaacaacgactggttctcgcgcctggcaagctctgcattcagtggactatttggtgcacttttggctgacaagaagacagaagagacaactctgcttgaagaccgcattctcaccaccaggaacggccacacaacatcgacgacacagtcgagcgttggcgtaacatacggttacgctgtggccgaggacgcggtgtctggacccaatacctcgggactcgagactcgtgttcaacaggcagaacggtttttcaagaaacacctgtttgactggacaccgaacttggcatttggacactgttactacctggaacttcccactgaacacaaaggcgtgtacggcagtctcatgggctcatacgcctacatgagaaatggatgggacatagaggtgactgctgttggaaaccaattcaacggtggttgtctccttgtcgcgctcgtgccagagctgaaggaactcgacacgcgacagaagtaccaactgaccctctttccccaccagttcatcaacccacgcaccaacatgacggcccacatcaacgtgccatacgtgggtatcaacaggtacgaccagtacgccctccacaagccgtggacgcttgttgtgatggtggtagccccactcaccgtcaaaactggtggttctgaacagatcaaggtttacatgaatgcagcgccaacctacgtgcatgtggcgggagagctgccctcgaaagagggaatagttcccgtcgcgtgtgcggacggttacggcaacatggtgacaacggacccgaagacggccgatccagtttacgggaaagtgttcaacccccccaggacaaacctccctgggcgcttcacgaacttccttgatgttgcggaggcatgtccaactttcctccgctttggagaagtaccatttgtgaagacggtgaactctggagaccgcttgctggccaagttcgacgtgtccctcgcagcagggcacatgtccaacacctacttggctggcctggcgcagtactacacacagtacagcggcaccatgaacgtccacttcatgttcaccggacccacggatgctaaagcccgatacatggtggcttatgtcccccctggcatgacaccgcccacggaccctgagcacgccgcacactgcattcactctgagtgggatactggtcttaactctaagtttaccttttccataccttacctctctgctgctgactatgcctacactgcttctgacgtggcggagaccacgagtgtgcagggatgggtgtgtatctatcagatcacccacggcaaggctgagggagacgcactggtcgtttctgtcagcgccggcaaagactttgagtttcgcttgcctgttgacgcacgccagcaaaccaccaccactggcgaatcagcagatccagtcacaaccacggttgagaactatggaggagagactcagacagccagacggcttcacactgacgtcgccttcattcttgacaggtttgtgaaactcactgctcccaagaacatccaaaccctcgatctcatgcagatcccctcacacacgctggttggagcactacttcgttctgcgacgtactacttctcagacctggaggtcgcgcttgtccacacaggcccagtcacctgggtgcccaacggagcgcccaaggatgctctaaacaaccagaccaacccaactgcctatcagaagcaacccatcacccgcctggcactcccctacaccgccccccatcgtgtgctggcaacagtgtacaacgggaagacggcttacggggaaacgacctcaaggcgcggcgacatggcggccctcgcacaaaggttgagcgctcggctgcccacctccttcaactacggcgccgtgaaggccgacaccatcactgagcttttgatccgcatgaagcgcgcggagacatattgccctaggcctttactagcccttgacaccactcaggaccgccgcaaacaggagatcattgcacctgagaagcaggttttgaactttgacctactcaagttggcaggagacgttgagtccaaccccgggcc

SEQ ID NO: 368 - DNA, 2250 bp, Foot-and-mouth disease virus
  CDS (1)..(2250)
  misc_feature (1)..(2250): P1_Asia1_Shamir_wildtype
ggagccggtcaatccagtccggcaaccgggtcacagaaccaatctggcaacactggaagcatcattaacaactactacatgcaacagtaccagaattccatggacacacagcttggtgacaacgctattagcggaggttccaacgaaggttccacggataccacttccacacacacaaacaacacccaaaacaacgactggttctcgcgcctggctagctctgcattcagtggtctctttggtgcacttttggctgacaagaagacagaagagacaactctgcttgaagaccgcattctcaccaccaggaacggccacacaacatcgacgacacagtcgagcgttggcgtaacatacggttacgctgtggccgaggacgcggtgtctggacccaatacctcgggtctagagactcgtgttcaacaggcagaacggtttttcaagaaacacctgtttgactggacaccgaacttggcatttggacactgttactacctggaacttcccactgaacacaaaggcgtgtacggcagtctcatgggctcgtacgcctacatgagaaatggatgggacatagaggtgactgctgttggaaaccaattcaacggtggttgtctccttgtcgcgctcgtgccagagctgaaggaactcgacacgcgacagaagtaccagctgaccctctttccccaccagttcatcaacccacgcaccaacatgacggcccacatcaacgtgccgtacgtgggtatcaacaggtacgaccagtacgccctccacaagccgtggacgcttgttgtgatggtggtagccccactcaccgtcaaaactggtggttctgaacagatcaaggtttacatgaatgcagcgccaacctacgtgcatgtggcgggagagctgccctcgaaagagggaatagttcccgtcgcgtgtgcggacggttacggcaacatggtgaccacggacccgaagacggccgatccagtttacgggaaagtgttcaacccccccaggacaaacctccctgggcgcttcacgaacttccttgatgttgcggaggcatgtccaactttcctccgctttggagaagtaccatttgtgaagacggtgaactctggtgaccgcttgctggccaagttcgacgtgtccctcgctgcagggcacatgtccaacacctacttggctggcctggcgcagtactacacacagtacagcggcaccatgaacgtccacttcatgttcaccgggcccacggatgctaaagcccgatacatggtggcttatgtcccccctggcatgacaccgcccacggaccctgagcacgccgcacactgcattcactctgagtgggatactggtcttaactctaagtttaccttttccataccttacctctctgctgctgactatgcctacactgcttctgacgtggcggagaccacgagtgtgcagggatgggtgtgtatctatcagatcacccacggcaaggctgagggagacgcactggtcgtttctgtcagcgccggcaaagactttgagtttcgcttgcctgttgacgcacgccagcaaaccaccaccactggcgaatcagcagatccagtcacaaccacggttgagaactatggaggagagactcagacagccagacggcttcacactgacgtcgccttcattcttgacaggtttgtgaaactcactgctcccaagaacatccaaaccctcgatctcatgcagatcccctcacacacgctggttggagcactacttcgttctgcgacgtactacttctcagacctggaggtcgcgcttgtccacacaggcccggtcacctgggtgcccaacggcgcgcccaaggatgctctaaacaaccagaccaacccaactgcctatcagaagcaacccatcacccgcctggcactcccctacaccgccccccatcgtgtgctggcaacagtgtacaacgggaagacggcgtacggggaaacgacctcaaggcgcggcgacatggcggccctcgcacaaaggttgagcgctcggctgcccacctccttcaactacggcgccgtgaaggccgacaccatcactgagcttttgatccgcatgaagcgcgcggagacatattgccctaggcctttactagcccttgacaccactcaggaccgccgcaaacaggagatcattgcacctgagaagcaggttttgaactttgacctactcaagttggcaggagacgttgagtccaaccctgggccc

SEQ ID NO: 369 - protein, 750 aa, Foot-and-mouth disease virus
GAGQSSPATGSQNQSGNTGSIINNYYMQQYQNSMDTQLGDNAISGGSNEGSTDTTSTHTNNTQNNDWFSRLASSAFSGLFGALLADKKTEETTLLEDRILTTRNGHTTSTTQSSVGVTYGYAVAEDAVSGPNTSGLETRVQQAERFFKKHLFDWTPNLAFGHCYYLELPTEHKGVYGSLMGSYAYMRNGWDIEVTAVGNQFNGGCLLVALVPELKELDTRQKYQLTLFPHQFINPRTNMTAHINVPYVGINRYDQYALHKPWTLVVMVVAPLTVKTGGSEQIKVYMNAAPTYVHVAGELPSKEGIVPVACADGYGNMVTTDPKTADPVYGKVFNPPRTNLPGRFTNFLDVAEACPTFLRFGEVPFVKTVNSGDRLLAKFDVSLAAGHMSNTYLAGLAQYYTQYSGTMNVHFMFTGPTDAKARYMVAYVPPGMTPPTDPEHAAHCIHSEWDTGLNSKFTFSIPYLSAADYAYTASDVAETTSVQGWVCIYQITHGKAEGDALVVSVSAGKDFEFRLPVDARQQTTTTGESADPVTTTVENYGGETQTARRLHTDVAFILDRFVKLTAPKNIQTLDLMQIPSHTLVGALLRSATYYFSDLEVALVHTGPVTWVPNGAPKDALNNQTNPTAYQKQPITRLALPYTAPHRVLATVYNGKTAYGETTSRRGDMAALAQRLSARLPTSFNYGAVKADTITELLIRMKRAETYCPRPLLALDTTQDRRKQEIIAPEKQVLNFDLLKLAGDVESNPGP

SEQ ID NO: 370 - DNA, 2247 bp, Artificial Sequence
  P1_C3_cut_sites_removed
ggagccggacaatccagcccggcgactggctcgcagaaccaatctggcaacactggtagcataatcaacaactactacatgcaacagtaccaaaattcaatggacacacaactgggtgacaatgctattagtggtggctccaacgagggctccacagatacaacttccacccacacaaccaacactcaaaacaacgactggttttccaaactcgccagttctgcctttagcggtcttttcggtgctcttcttgccgacaagaagaccgaggaaaccacactacttgaagaccgcatcctcaccacccgcaacggccacacgacttcgacaactcagtcgagcgttggggtcacatacgggtacgcaacaactgaggatagcacgtcagggcctaacacatccggccttgagacacgtgttcaccaggcagaacggtttttcaagatgacactctttgaatgggttccctcccagagttttggacacatgcacaaggtcgttctgccctcagaaccgaaaggtgtctatgggggtctcgtcaagtcttatgcgtacatgcgcaatggctgggacgttgaggtgactgctgttggaaaccagttcaacggcggttgtctcctggtggcgctcgttcctgaaatgggtgacatcagtgacagagagaagtaccaactgactctctacccccaccaattcatcaacccacgcactaacatgacggcacacatcaccgtgccttacgtgggtgtcaacagatacgaccaatacaaccaacacaagccctggactcttgtcgtcatggtcgttgctccacttactgtgaacacatcaggtgcccagcagatcaaggtgtatgccaacatagccccaaccaacgttcacgttgctggtgaacttccctccaaggaggggatcttccccgttgcgtgtgccgacggctatggcaacatggtgacaactgacccgaagacggctgaccctgcctacgggaaagtctataatccacccaggaccgccctgccgggccggttcacaaactacctggatgttgctgaggcttgccccactctcctgacgttcgagaacgtgccttacgtttcaacacggactgatggacaaaggctgttggccaagttcgacgtgtcattggcagcgaaacacatgtcaaacacttacttggctggcttggcccagtactacacacagtacgctgggacaatcaacctgcacttcatgttcactgggccaaccgacgcgaaagctcggtacatggtggcatacgtgccccctggcatggaagcaccagacaacccagaggaggctgcccactgcatacacgcagagtgggacactggtttgaactctaagttcacattttcaatcccgtacatctcggccgctgactacgcatacaccgcgtccagcgaggctgaaacaacaagcgtacagggatgggtttgtgtgtaccagatcactcacggcaaggcagacgctgacgcgctcgtcgtctccgcttcggcggggaaagactttgaactccggctacctgtggacgctagacagcaaactacgaccactggcgaatctgccgaccccgtcaccactaccgttgagaactacggaggagaaacacaaactcaacgtcgccaccacactgacgttgccttcgttcttgatcggtttgtgaaggtccaggtgtcgggcaaccaacacacactggacgttatgcaggtacacaaggacagtattgtgggtgcactcctacgcgcagccacatactacttctctgacttggaaatagcagtgactcacactgggaagctcacatgggtgcccaacggcgccccagtttctgcacttgacaacacaaccaaccccactgcctaccacaaggggccgctgactcggctggctctcccatacaccgcaccacaccgcgtgctggccacggcgtacactggtacaacggcctacactacaggtgtacgcaggggagacctagcccacttggcggcggcgcacgctcggcacctgccaacgtcgttcaactttggtgcagttaaagcagagacaatcacagagctgcttgtgcgcatgaagcgtgctgaactctactgccccaggccggtccttccggtccaaccagcgggcgataggcacaaacaaccgctcattgcgccagcgaaacaactgctgaacttcgaccttctcaagttggcgggagatgtcgagtccaaccctgggccc

SEQ ID NO: 371 - DNA, 2247 bp, Foot-and-mouth disease virus
  CDS (1)..(2247)
  misc_feature (1)..(2247): P1_C3_wildtype
ggagccggacaatccagcccggcgactggctcgcagaaccaatctggcaacactggtagcataatcaacaactactacatgcaacagtaccaaaattccatggacacacagctgggtgacaatgctattagtggtggctccaacgagggctccacagatacaacttccacccacacaaccaacactcaaaacaacgactggttttccaaactcgccagttctgcctttagcggtcttttcggtgctcttcttgccgacaagaagaccgaggaaaccacactacttgaagaccgcatcctcaccacccgcaacggccacacgacgtcgacaactcagtcgagcgttggggtcacatacgggtacgcaacaactgaggatagcacgtcagggcccaacacatccggccttgagacacgtgttcaccaggcagaacggtttttcaagatgacactctttgaatgggttccctcccagagttttggacacatgcacaaggtcgttctgccctcagaaccgaaaggtgtctatgggggtctcgtcaagtcatacgcgtacatgcgcaatggctgggacgttgaggtgactgctgttggaaaccagttcaacggcggttgtctcctggtggcgctcgttcctgaaatgggtgacatcagtgacagagagaagtaccaactgactctctacccccaccaattcatcaacccacgcactaacatgacggcacacatcaccgtgccttacgtgggtgtcaacagatacgaccaatacaaccaacacaagccctggactcttgtcgtcatggtcgttgctccacttactgtgaacacatcaggtgcccagcagatcaaggtgtatgccaacatagccccaaccaacgttcacgttgctggtgaacttccctccaaggaggggatcttccccgttgcgtgtgccgacggctatggcaacatggtgacaactgacccgaagacagctgaccctgcctacgggaaagtctacaatccacccaggaccgccctgccgggccggttcacaaactacctggatgttgctgaggcttgccccactctcctgacgttcgagaacgtgccttacgtttcaacacggactgatggacaaaggctgttggccaagttcgacgtgtcattggcagcgaaacacatgtcaaacacttacttggctggcttggcccagtactacacacagtacgctgggacaatcaacctgcacttcatgttcactgggccaaccgacgcgaaagctcggtacatggtggcatacgtgccccctggcatggaagcaccagacaacccagaggaggctgcccactgcatacacgcagagtgggacactggtttgaactctaagttcacattttcaatcccgtacatctcggccgctgactacgcatacaccgcgtccagcgaggctgaaacaacaagcgtacagggatgggtttgtgtgtaccagatcactcacggcaaggcagacgctgacgcgctcgtcgtctccgcttcggcggggaaagactttgagctccggctacctgtggacgctagacagcaaactacgaccactggcgaatctgccgaccccgtcaccactaccgttgagaactacggaggagaaacacaaactcaacgtcgccaccacactgacgttgccttcgttcttgaccggtttgtgaaggtccaggtgtcgggcaaccaacacacactggacgttatgcaggtacacaaggacagtattgtgggtgcactcctacgcgcagccacatactacttctctgacttggaaatagcagtgactcacactgggaagctcacatgggtgcccaacggcgccccagtttctgcacttgacaacacaaccaaccccactgcctaccacaaggggccgctgactcggctggctctcccatacaccgcaccacaccgcgtgctggccacggcgtacaccggtacaacggcctacactaccggtgtacgcaggggagacctagcccacttggcggcggcgcacgctcggcacctgccgacgtcgttcaactttggtgcagttaaagcagagacaatcacagagctgcttgtgcgcatgaagcgtgctgaactctactgccccagaccggtccttccggtccaaccagcgggcgataggcacaaacaaccgctcattgcgccagcgaaacagctgctgaacttcgaccttctcaagttggcgggagacgtcgagtccaaccctgggccc

SEQ ID NO: 372 - protein, 749 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYATTEDSTSGPNTSGLETRVHQAERFFKMTLFEWVPSQSFGHMHKVVLPSEPKGVYGGLVKSYAYMRNGWDVEVTAVGNQFNGGCLLVALVPEMGDISDREKYQLTLYPHQFINPRTNMTAHITVPYVGVNRYDQYNQHKPWTLVVMVVAPLTVNTSGAQQIKVYANIAPTNVHVAGELPSKEGIFPVACADGYGNMVTTDPKTADPAYGKVYNPPRTALPGRFTNYLDVAEACPTLLTFENVPYVSTRTDGQRLLAKFDVSLAAKHMSNTYLAGLAQYYTQYAGTINLHFMFTGPTDAKARYMVAYVPPGMEAPDNPEEAAHCIHAEWDTGLNSKFTFSIPYISAADYAYTASSEAETTSVQGWVCVYQITHGKADADALVVSASAGKDFELRLPVDARQQTTTTGESADPVTTTVENYGGETQTQRRHHTDVAFVLDRFVKVQVSGNQHTLDVMQVHKDSIVGALLRAATYYFSDLEIAVTHTGKLTWVPNGAPVSALDNTTNPTAYHKGPLTRLALPYTAPHRVLATAYTGTTAYTTGVRRGDLAHLAAAHARHLPTSFNFGAVKAETITELLVRMKRAELYCPRPVLPVQPAGDRHKQPLIAPAKQLLNFDLLKLAGDVESNPGP

SEQ ID NO: 373 - DNA, 2259 bp, Artificial Sequence
  P1_O1_Manissa_cut_sites_removed
ggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggccc

SEQ ID NO: 374 - DNA, 2259 bp, Foot-and-mouth disease virus
  CDS (1)..(2259)
  misc_feature (1)..(2259): P1_01_Marissa_wild_type
ggagccgggcaatccagcccggcaaccgggtcacagaaccaatcaggcaacactgggagcatcatcaacaattactacatgcagcagtaccaaaactccatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttctcgaggaccgcatcctcactactcgtaacggacacaccacctcgacaacccagtcgagcgttggagtcacgtacgggtatgcaacagctgaggatttcgtgagcgggccaaacacctctggtctcgagaccagggttgcccaggcagagcggttctttaaaacccacctgttcgactgggtcaccagtgacccgttcggacggtgccacctgctggaacttccaactgaccacaaaggtgtctacggcagcctgaccgactcgtatgcttatatgaggaacggctgggatgttgaagtcactgcagtgggaaaccagttcaatggaggatgcctgttggtggccatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgaccactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtcgaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcattcatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggctagcgccggaaaggactttgagctgcgcctgccggtggatgctcgcacacagactacctccgcgggcgagtcagctgaccccgtgaccgccaccgttgagaattacggtggcgagacacaggtccagaggcgccaacacacggacgtctcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtcccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgacctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggcaccggtgaaacagcttctaaattttgacctgctcaaattggcgggagatgtggagtccaaccctgggccc

SEQ ID NO: 375 - protein, 753 aa, Foot-and-mouth disease virus
GAGQSSPATGSQNQSGNTGSIINNYYMQQYQNSMDTQLGDNATSGGSNEGSTDTTSTHTTNTQNNDWFSKLASSAFSGLFGALLADKKTEETTLLEDRILTTRNGHTTSTTQSSVGVTYGYATAEDFVSGPNTSGLETRVAQAERFFKTHLFDWVTSDPFGRCHLLELPTDHKGVYGSLTDSYAYMRNGWDVEVTAVGNQFNGGCLLVAMVPELCSIQKRELYQLTLFPHQFINPRTNMTAHITVPFVGVNRYDQYKVHKPWTLVVMVVAPLTVNSEGAPQIKVYANIAPTNVHVAGEFPSKEGIFPVACSDGYGGLVTTDPKTADPAYGKVFNPPRNMLPGRFTNFLDVAEACPTFLHFEGDVPYVTTKTDSDRVLAQFDLSLAAKHMSNTFLAGLAQYYTQYSGTINLHFMFTGPTDAKARYMIAYAPPGMEPPKTPEAAAHCIHAEWDTGLNSKFTFSIPYLSAADYAYTASDTAETTNVQGWVCLFQITHGKADGDALVVLASAGKDFELRLPVDARTQTTSAGESADPVTATVENYGGETQVQRRQHTDVSFILDRFVKVTPKDQINVLDLMQTPAHTLVGALLRTATYYFADLEVAVKHEGNLTWVPNGAPEAALDNTTNPTAYHKAPLTRLALPYTAPHRVLATVYNGNSKYGDGTVANVRGDLQVLAQKAARALPTSFNYGAIKATRVTELLYRMKRAETYCPRPLLAIHPDQARHKQKIVAPVKQLLNFDLLKLAGDVESNPGP

SEQ ID NO: 376 - DNA, 2259 bp, Artificial Sequence
  P1_O1_pan_Asia_cut_sites_removed
ggtgctgggcaatccagcccggcgactgggtcacagaaccagtcaggcaacactggaagcatcatcaacaactactacatgcagcagtaccagaactccatggacacacaacttggtgacaacgctatcagcggaggctctaacgaaggttctacagacaccacctccacccacacaaccaacactcagaacaacgactggttttcaaaactagccagttccgctttcagcggtcttttcggcgctcttctcgccgacaagaaaaccgaggagactactcttcttgaggaccgcatcctcactacccgtaacggacacacaacctcgacaacccagtcgagcgttggagtcacttacgggtacgcaacagccgaggattttgtgagcgggccaaacacatctggccttgagaccagggttgtgcaagcagagcggttcttcaaaacccacttgttcgattgggtcactagtgactcgttcggacgatgccacctgctggaacttccaactgaccacaaaggtgtctatggcagcctgactgattcttatgcgtacatgagaaacggttgggatgtcgaggtcactgcggtgggaaaccagttcaacggaggatgcctgttggtggccatggtgccagaactctgctctatcagcaaaagagagctgtaccagctcacgctctttccccaccagttcatcaacccccggacgaacatgacggcacacatcaccgtgccctttgtcggcgtcaaccgctacgaccagtacaaggtacacaaaccttggaccctcgtggtcatggtcgtggccccgctgactgtcaacactgaaggtgctccacagatcaaggtttatgccaacatcgcccctaccaacgtgcacgtcgcgggtgagttcccctccaaggaagggatcttccccgtggcctgcagtgacggttacggcggtcttgtgaccactgacccaaagacggctgaccccgtttacgggaaagttttcaatccccctcgcagcatgttgccagggcgattcaccaacttccttgatgtggctgaggcgtgccctacgtttctgcattttgagggtgacgtaccatacgtgaccacaaagacggattcggacagggttctcgctcagtttgacttgtctttggcagcgaagcacatgtcaaacacctttcttgcaggtctcgcccagtactacgcacagtacagtggcactattaacctgcacttcatgttcacagggccaactgacgcgaaagcgcgttacatgattgcctatgccccccccggcatggagccgcctaaaacacctgaggcagccgctcactgcattcacgcggagtgggatactggattgaactcaaaattcacattctcaatcccttacctctcggcggctgactatgcgtacaccgcgtctgacaccgccgagaccacaaatgtacagggatgggtttgcctgtttcaaatcacgcacgggaaggccgatggtgacgcacttgttgtcctggccagcgccggtaaggacttcgagctgcggttgccagttgatgcccgcacgcagaccacctccacaggtgagtcagctgaccccgtgactgccactgttgagaactacggtggcgaaacacaggtccagagacgccagcacacggacgtctcgtttatattggacagatttgtgaaagtgacaccaaaagaccaaatcaatgtgttggacctgatgcaaacccccgcccacactttggtaggtgcactcctccgcaccgccacctactacttcgcagatttagaggtggcagtaaaacacgaggggaaccttacctgggtcccgaatggggcgcccgagacagcgttggataacaccactaatccaacggcttaccacaaggcaccgctcactcgtcttgcactgccttacacggcaccgcaccgtgtcttggctaccgtttacaacgggaactgcaagtacgacgagagcagcacaaccaacgtgagaggagacctgcaagtgttggcccaaaaggcggcgaggacgctgcccacctccttcaactacggtgccatcaaagctacacgggtgaacgagttgctttaccgcatgaagagggctgaaacatactgcccccggcctcttttggccattcatccgaatgaagcaagacacaagcaaaagatagtggcacctgcgaagcaactcctgaacttcgacctgctcaagttggcgggagacgttgagtccaaccccgggccc

SEQ ID NO: 377 - DNA, 2259 bp, Foot-and-mouth disease virus
  CDS (1)..(2259)
  misc_feature (1)..(2259): P1_O1_pan_Asia_wildtype
ggtgctgggcaatccagcccggcgactgggtcacagaaccagtcaggcaacactggaagcatcatcaacaactactacatgcagcagtaccagaactccatggacacacaacttggtgacaacgctatcagcggaggctctaacgaagggtctacagacaccacctccacccacacaaccaacactcagaacaacgactggttttcaaaactagccagttccgctttcagcggtcttttcggcgctcttctcgccgacaagaaaaccgaggagactactcttctcgaggaccgcatcctcactacccgtaacggacacacaacctcgacaacccagtcgagcgttggagtcacttacgggtacgcaacagccgaggattttgtgagcgggccaaacacatctggccttgagaccagggttgtgcaagcagagcggttcttcaaaacccacttgttcgattgggtcactagtgactcgttcggacgatgccacctgctggaacttccaactgaccacaaaggtgtctacggcagcctgactgattcttatgcgtacatgagaaacggttgggatgtcgaggtcactgcggtgggaaaccagttcaacggaggatgcctgttggtggccatggtgccagaactctgctctatcagcaaaagagagctgtaccagctcacgctctttccccaccagttcatcaacccccggacgaacatgacggcacacatcaccgtgccctttgtcggcgtcaaccgctacgaccagtacaaggtacacaaaccttggaccctcgtggtcatggtcgtggccccgctgactgtcaacactgaaggtgctccacagatcaaggtttatgccaacatcgcccctaccaacgtgcacgtcgcgggtgagttcccctccaaggaagggatcttccccgtggcctgcagtgacggttacggcggtcttgtgaccactgacccaaagacggctgaccccgtttacgggaaagttttcaatccccctcgcagcatgttgccagggcgattcaccaacttccttgatgtggctgaggcgtgccctacgtttctgcattttgagggtgacgtaccatacgtgaccacaaagacggattcggacagggttctcgctcagtttgacttgtctttggcagcgaagcacatgtcaaacacctttcttgcaggtctcgcccagtactacgcacagtacagtggcactattaacctgcacttcatgttcacagggcccactgacgcgaaagcgcgttacatgattgcatatgccccccccggcatggagccgcctaaaacacctgaggcagccgctcactgcattcacgcggagtgggatactggattgaattcaaaattcacattctcaatcccttacctctcggcggctgactacgcgtacaccgcgtctgacaccgccgagaccacaaatgtacagggatgggtttgcctgtttcaaatcacgcacgggaaggccgatggtgacgcacttgttgtcctggctagcgccggtaaggacttcgagctgcggttgccagttgatgcccgcacgcagaccacctccacaggtgagtcagctgaccccgtgactgccactgttgagaactacggtggcgaaacacaggtccagagacgccagcacacggacgtctcgtttatattggacagatttgtgaaagtgacaccaaaagaccaaatcaatgtgttggacctgatgcaaacccccgcccacactttggtaggtgcactcctccgcaccgccacctactacttcgcagatttagaggtggcagtaaaacacgaggggaaccttacctgggtcccgaatggggcgcccgagacagcgttggataacaccactaatccaacggcttaccacaaggcaccgctcactcgtcttgcactgccttacacggcaccgcaccgtgtcttggctaccgtttacaacgggaactgcaagtacgacgagagcagcacaaccaacgtgagaggtgacctgcaagtgttggcccaaaaggcggcgaggacgctgcccacctccttcaactacggtgccatcaaagctacccgggtgaacgagttgctttaccgcatgaagagggctgaaacatactgcccccggcctcttttggccattcatccgaatgaagcaagacacaagcaaaagatagtggcacctgcgaagcaactcctgaacttcgacctgctcaagttggcgggagacgttgagtccaaccctgggccc

SEQ ID NO: 378 - protein, 753 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYATAEDFVSGPNTSGLETRVVQAERFFKTHLFDWVTSDSFGRCHLLELPTDHKGVYGSLTDSYAYMRNGWDVEVTAVGNQFNGGCLLVAMVPELCSISKRELYQLTLFPHQFINPRTNMTAHITVPFVGVNRYDQYKVHKPWTLVVMVVAPLTVNTEGAPQIKVYANIAPTNVHVAGEFPSKEGIFPVACSDGYGGLVTTDPKTADPVYGKVFNPPRSMLPGRFTNFLDVAEACPTFLHFEGDVPYVTTKTDSDRVLAQFDLSLAAKHMSNTFLAGLAQYYAQYSGTINLHFMFTGPTDAKARYMIAYAPPGMEPPKTPEAAAHCIHAEWDTGLNSKFTFSIPYLSAADYAYTASDTAETTNVQGWVCLFQITHGKADGDALVVLASAGKDFELRLPVDARTQTTSTGESADPVTATVENYGGETQVQRRQHTDVSFILDRFVKVTPKDQINVLDLMQTPAHTLVGALLRTATYYFADLEVAVKHEGNLTWVPNGAPETALDNTTNPTAYHKAPLTRLALPYTAPHRVLATVYNGNCKYDESSTTNVRGDLQVLAQKAARTLPTSFNYGAIKATRVNELLYRMKRAETYCPRPLLAIHPNEARHKQKIVAPAKQLLNFDLLKLAGDVESNPGP

SEQ ID NO: 379 - DNA, 2289 bp, Artificial Sequence
  P1_SAT1_KNP/196/91_cut_sites_removed
ggagcgggccagtcgtcccccgccactgggtcacagaaccagtcaggcaacactggcagcatcatcaacaactactacatgcaacagtaccaaaattcaatggacacccaactcggagacaacgccatctccggtgggtcaaatgagggttcgaccgacacaacttcgacccacaccagcaacacccaaaacaacgattggttttcaaaattggctcaatcggccttctctggattggttggtgcgttgcttgccgacaagaagactgaggaaaccacactccttgaggatcgcatcctcacgaccagtcacggcacaaccacctcgaccacacaaagttcagtgggcataacctacggttacgccgactcggaccgtttcctccccggcccaaacaccaacgggctggagacacgtgtggaacaagcagagaggtttttcaaacacaaattatttgattggacacttgaacaacgatttggaacaacacacgttttggaactgcccacagaccacaaaggcatctatggacaacttgttgactcccactcatacattcgcaatgggtgggacgttgaggtctccgcgaccgcaacgcagttcaacgggggctgcctcctggtagcgatggtgcccgaattgtgcaaactgtcggaaagagagaaataccaactcactctcttccctcatcaatttctagacccaaggaccaacaccacggcacacatccaggttccctacctgggcgtggatcgccacgaccaaggaacacgccacaaagcgtggaccctggttgtcatggtggtggcaccctacacaaacgatcagacgattggctcgaacaaagccgaggtgtacgtgaacattgctcccacaaacgtttacgtcgccggtgagaagcccgcaaaacagggcattctccccgtggccgtctccgttggctatggtggcttccaaaatacagatcccaaaacatcggaccccgtatatgggcacgtgtacaacccggctcgcaccggcctacctgggaggttcacaaacctcttggatgtggctgaagcgtgccctacactgcttgacttcaacggagttccgtatgtgaccacccaggcaaactcaggatctaaagtgttaacttgttttgatttggcttttggtcacaaaaatttgaaaaatacatttatgtctggtcttgcccagtactacacccagtacagtggcacactcaacctgcacttcatgtacacaggcccaaccaacaacaaggctaagtacatggtggcctacatcccacctgggacacaccctctcccggaaacaccggagatggagtcccactgtcaccacgccgagtgggacacaggcctgaactcaaccttcacattcaccgtgccgtatgtgtcggctgccgacttcgcgtacacctactctgacgagcctgaacaggcttcggttcagggttgggtgggcgtatatcaggtgactgacacacacgagaaggacggtgcagttgttgtgtccgtcagtgctggacccgacttcgagttcaggatgcccatcagcccctcgcgccagaccacatccgctggcgaaggagcggagcctgtcacgactgatgcttcccaacacggaggcgacagacggacaactcgtaggcatcacactgatgtgagcttcttgctcgatcggttcacactggttggtaaaacacaggacaacaaactgacactagacctgctccaaaccaaggaaaaagcactggttggcgcaatcctgcgcgcagccacgtactacttctctgacttggaggttgcgtgtgtgggtgacaacaaatgggtcggctggactcccaacggtgctccagaacttgcggaagtgggcgacaacccagtcgtcttttccaaaggtagaaccacccgttttgcactgccctacaccgctccacacaggtgcttggcgacagcctacaacggtgactgcaagtacaaacccactggcacagctccacgcgaaaacattcgtggagacctcgcaactctcgcggcgaggattgcaagtgagacacacattccaaccaccttcaactatggcaggatttacacagacactgaggtcgatgtgtacgtcaggatgaagcgcgcggaactctactgcccgcgacccgttctcacgcactacgaccacggtggcagggatcgctacagaactgcgatcaccaaacctgtcaaacagatgtgcagtttcgacctgttaaagctggctggagacgttgagtccaaccctgggccc

SEQ ID NO: 380 - DNA, 2289 bp, Foot-and-mouth disease virus
  CDS (1)..(2289)
  misc_feature (1)..(2289): P1_SAT1_KNP/196/91_wildtype
ggagcgggccagtcgtcccccgccactgggtcccagaaccagtctggcaacactggcagcatcatcaacaactactacatgcaacagtaccaaaattccatggacacccaactcggagacaacgccatctccggtgggtcaaatgagggttcgaccgacacaacgtcgacccacaccagcaacacccaaaacaacgattggttttcaaaattggctcaatcggccttctctggattggttggtgcgttgcttgccgacaagaagactgaggaaaccacactcctcgaggatcgcatcctcacgaccagtcacggcacaaccacctcgaccacacaaagttcagtgggcataacctacggttacgccgactcggaccgtttcctccccggcccaaacaccaacgggctggagacacgtgtggaacaagcagagaggtttttcaaacacaaattatttgattggacacttgaacaacgatttggaacaacacacgttttggaactgcccacagaccacaaaggcatctatggacaacttgttgactcccactcatacattcgcaatgggtgggacgttgaggtctccgcgaccgcaacgcagttcaacgggggctgcctcctggtagcgatggtgcccgaattgtgcaaactgtcggaaagagagaaataccaactcactctcttccctcatcaatttctcgacccaaggaccaacaccacggcacacatccaggtaccctacctgggcgtggatcgccacgaccaaggaacacgccacaaagcgtggaccctggttgtcatggtggtggcaccctacacaaacgatcagacgattggctcgaacaaagccgaggtgtacgtgaacattgctcccacaaacgtttacgtcgccggtgagaagcccgcaaaacagggcattctccccgtggccgtctccgttggctatggtggcttccaaaatacagatcccaaaacatcggaccccgtatacgggcacgtgtacaacccggctcgcaccggcctacctgggaggttcacaaacctcttggatgtggctgaagcgtgccctacactgcttgacttcaacggagttccgtacgtgaccacccaggcaaactctggatctaaagtgttaacttgttttgatttggcttttggtcacaaaaatttgaaaaatacatttatgtctggtcttgcccagtactacacccagtacagtggcacactcaacctgcacttcatgtacacaggcccaaccaacaacaaggctaagtacatggtggcctacatcccacctgggacacaccctctcccggaaacaccggagatggagtcccactgtcaccacgccgagtgggacacaggcctgaactcaaccttcacattcaccgtgccgtacgtgtcggctgccgacttcgcgtacacctactctgacgagcctgaacaggcttcggttcagggttgggtgggcgtataccaggtgactgacacacacgagaaggacggtgcagttgttgtgtccgtcagtgctggacccgacttcgagttcaggatgcccatcagcccctcgcgccagaccacatccgctggcgaaggagcggagcctgtcacgactgatgcttcccaacacggaggcgacagacggacaactcgtaggcatcacactgatgtgagcttcttgctcgaccggttcacactggttggtaaaacacaggacaacaaactgacactagacctgctccaaaccaaggaaaaagcactggttggcgcaatcctgcgcgcagccacgtactacttctctgacttggaggttgcgtgtgtgggtgacaacaaatgggtcggctggactcccaacggagctccagaacttgcggaagtgggcgacaacccagtcgtcttttccaaaggtagaaccacccgttttgcactgccctacaccgctccacacaggtgcttggcgacagcctacaacggtgactgcaagtacaaacccactggcacagctccacgcgaaaacattcgtggagacctcgcaactctcgcggcgaggattgcaagtgagacacacattccaaccaccttcaactatggcaggatttacacagacactgaggtcgacgtgtacgtcaggatgaagcgcgcggagctctactgcccgcgacccgttctcacgcactacgaccacggtggcagggatcgctacagaactgcgatcaccaaacctgtcaaacagatgtgcagtttcgacctgttaaagctggctggagacgttgagtccaaccctgggccc

SEQ ID NO: 381 - protein, 763 aa, Foot-and-mouth disease virus
GAGQSSPATGSQNQSGNTGSIINNYYMQQYQNSMDTQLGDNAISGGSNEGSTDTTSTHTSNTQNNDWFSKLAQSAFSGLVGALLADKKTEETTLLEDRILTTSHGTTTSTTQSSVGITYGYADSDRFLPGPNTNGLETRVEQAERFFKHKLFDWTLEQRFGTTHVLELPTDHKGIYGQLVDSHSYIRNGWDVEVSATATQFNGGCLLVAMVPELCKLSEREKYQLTLFPHQFLDPRTNTTAHIQVPYLGVDRHDQGTRHKAWTLVVMVVAPYTNDQTIGSNKAEVYVNIAPTNVYVAGEKPAKQGILPVAVSVGYGGFQNTDPKTSDPVYGHVYNPARTGLPGRFTNLLDVAEACPTLLDFNGVPYVTTQANSGSKVLTCFDLAFGHKNLKNTFMSGLAQYYTQYSGTLNLHFMYTGPTNNKAKYMVAYIPPGTHPLPETPEMESHCHHAEWDTGLNSTFTFTVPYVSAADFAYTYSDEPEQASVQGWVGVYQVTDTHEKDGAVVVSVSAGPDFEFRMPISPSRQTTSAGEGAEPVTTDASQHGGDRRTTRRHHTDVSFLLDRFTLVGKTQDNKLTLDLLQTKEKALVGAILRAATYYFSDLEVACVGDNKWVGWTPNGAPELAEVGDNPVVFSKGRTTRFALPYTAPHRCLATAYNGDCKYKPTGTAPRENIRGDLATLAARIASETHIPTTFNYGRIYTDTEVDVYVRMKRAELYCPRPVLTHYDHGGRDRYRTAITKPVKQMCSFDLLKLAGDVESNPGP

SEQ ID NO: 382 - DNA, 2277 bp, Artificial Sequence
  P1_SAT2_Egypt_2010_cut_sites_removed
ggggccgggcaatccagcccggctactggttcccaaaatcaatcaggcaatactggtagcattattaacaactactacatgcaacagtaccagaactcaatggacacacagcttggtgacaacgccattagcggtggttccaacgaggggtcaacggacaccacgtcaacacacacaaacaacacacagaacaatgactggttttccaaattggctcaatcagccatttcagggcttttcggtgctctgcttgcagacaagaaaacagaggagaccacactgctggaggacagaatcctgaccacacgtcacgggaccacgacctccaccacgcaaagttctgtgggagtgacatttggttatgctgatgctgattcgtttcgcccaggaccaaacacctctgggcttgagacgcgcgtgcaacaggcagaacgcttcttcaaggagaaactttttgactggaccagtgacaaacctttcggtacgctgtacgtgttggagttgcccaaagaccacaagggcatctacggtaaacttaccgactcctacacgtacatgcgtaacggttgggacgttcaggtcagcgcgaccagcacacagtttaacggcggatcactgctcgtggcaatggtcccagagttgtgcagtctaaaagccagagaagaatttcaactcactctctacccacaccagttcattaacccgcgcaccaacacaaccgcacacatacaggttccttacctgggtgtaaacagacacgaccagggtaagcgccaccaggcgtggtctctggttgtgatggtgctcacgcctcttaccaccgaggcgcagatgaacagcggcaccgtcgaggtgtacgccaacatcgcaccaacaaatgtggttgtggcgggtgaactgccgggtaagcagggcatcattccggtcgctgccgctgacgggtatggtggtttccagaacaccgacccgaaaacggctgaccccatttacgggcatgtgtacaacccgtccagaaacgactgccacgggcgatactccaatcttatggatgtcgccgaggcgtgtccaacactcctcaactttgatggcaagccctacgtcgtgaccaagaacaacggtgacaaggtgatggcacgcttcgatgtcgcctttacacacaaggtgcatgggaacacgtttctggcgggcttggccgactactacacacagtattcaggcagcctaaactaccacttcatgtacactggacccacacatcacaaggcaaagttcatggtggcatacgtgccccctggtgttgcagttgaccaactgcctagcacaccggaggatgctgcgcactgctaccatgcggaatgggacaccgggttgaactcttctttctcgttcgcagtgccttacatctccgctgcggacttttcttacacacacacagacacaccagcaatggccaccactaatggctgggtagttgtactacaggtcacagacacgcactctgcggaagctgccgttgtagtgtcagtcagcgcgggaccagatttggagttccgattccctatcgaccctgtgcgacagactacctcggcgggagaaggcgcagatgttgtcaccacggacccatcgacacacggtgggaatgttcaagagggacgacgcaaacacaccgacgttgcgttccttcttgatcgcagtacacacgttcacacaaataagacatcttttgttgtggacctcatggacacaagggagaaggcgctcgtaggcgcaatcctgcgagcatccacctactacttttgtgaccttgaaattgcatgtgtgggcgaccacacaagggtcttctggcagcccaacggggcaccacggactacccagctcggcgacaaccctatggtttttgccaagggcggcgtaacccgctttgccatcccgtttacggctccacacaggctgctatctactgtttacaacggcgagtgtgtgtacaccaaggccgccgctgccattcgtggtgatcgtgcggcacttgcggcaaagtacgctgacaccaaccacactttgccgccaaccttcaacttcgggtacgtgaccgttgacaaaccagttgacgtttactaccggatgaagagggctgagctgtactgcccacgcccactgctgccagcctacaaacacacagacagagacagattcgacgcgcccatcggcgtcgaaagacagaccctgaattttgacctgctgaaactggcaggagacgttgagtccaaccctgggccc

SEQ ID NO: 383 - DNA, 2277 bp, Foot-and-mouth disease virus
  CDS (1)..(2277)
  misc_feature (1)..(2277): P1_SAT2_Egypt_2010_wildtype
ggggccgggcaatccagcccggctactggatcccaaaatcaatcaggcaatactggtagcattattaacaactactacatgcaacagtaccagaactcaatggacacacagcttggtgacaacgccattagcggtggttccaacgaggggtcgacggacaccacgtcgacacacacaaacaacacacagaacaatgactggttttccaaattggctcaatcagccatttcagggcttttcggagctctgcttgcagacaagaaaacagaggagaccacactgctggaggacagaatcctgaccacgcgtcacgggaccacgacctccaccacgcaaagttctgtgggagtgacatttggttatgctgatgctgattcgtttcgcccaggacccaacacctctgggcttgagacgcgcgtgcaacaggcagaacgcttcttcaaggagaagctttttgactggaccagtgacaaacctttcggtacgctgtacgtgttggagttgcccaaagaccacaagggcatctacggtaaacttaccgactcctacacgtacatgcgtaacggttgggacgttcaggtcagcgcgaccagcacacagtttaacggcggatcactgctcgtggcaatggtcccagagttgtgcagtctaaaagccagagaagaatttcaactcactctctacccacaccagttcattaacccgcgcaccaacacaaccgcacacatacaggttccttacctgggtgtaaacagacacgaccagggtaagcgccaccaggcgtggtctctggttgtgatggtgctcacgcctcttaccaccgaggcgcagatgaacagcggcaccgtcgaggtgtacgccaacatcgcaccaacaaatgtggttgtggcgggtgaactgccgggtaagcagggcatcattccggtcgctgccgctgacgggtatggtggtttccagaacaccgacccgaaaacggctgaccccatttacgggcatgtgtacaacccgtccagaaacgactgccacgggcgatactccaatcttatggatgtcgccgaggcgtgtccaacactcctcaactttgatggcaagccctacgtcgtgaccaagaacaacggtgacaaggtgatggcacgcttcgacgtcgcctttacacacaaggtgcatgggaacacgtttctggcgggcttggccgactactacacacagtattcaggcagcctaaactaccacttcatgtacactggacccacacatcacaaggcaaagttcatggtggcatacgtgccccctggtgttgcagttgaccagctgcctagcacaccggaggatgctgcgcactgctaccatgcggaatgggacaccgggttgaattcttctttctcgttcgcagtgccttacatctccgctgcggacttttcttacacacacacagacacaccggccatggccaccaccaatggctgggtggttgtactgcaggtcaccgacacgcactctgcggaagctgccgttgtagtgtcagtcagcgcgggaccagatttggaattccgattccctatcgaccctgtgcgacagactacctcggcgggagaaggcgcagatgttgtcaccacggacccatcgacacacggtgggaatgttcaagagggtcgacgcaaacacaccgacgttgcgttccttcttgatcgcagtacacacgttcacacaaataagacatcttttgttgtggacctcatggacacaagggagaaggcgctcgtaggcgcaatcctgcgagcatccacctactacttttgtgaccttgaaattgcatgtgtgggcgaccacacaagggtcttctggcagcccaacggggcaccgcggactacccagctcggcgacaaccctatggtttttgccaagggcggcgtaacccgctttgccatcccgtttacggctccacacaggctgctgtctactgtttacaacggcgagtgtgtctacaccaaggccgccgctgccattcgtggtgatcgtgcggcacttgcggcaaagtacgctgacaccaaccacactttgccgccaaccttcaacttcgggtacgtgaccgttgacaaaccagtcgacgtttactaccggatgaagagggctgagctgtactgcccacgcccactgctgccagcctacaaacacacagacagagacagattcgacgcgcccatcggcgtcgaaagacagaccctgaattttgacctgctgaaactggcaggagacgttgagtccaaccctgggccc

SEQ ID NO: 384 - protein, 759 aa, Foot-and-mouth disease virus
GAGQSSPATGSQNQSGNTGSIINNYYMQQYQNSMDTQLGDNAISGGSNEGSTDTTSTHTNNTQNNDWFSKLAQSAISGLFGALLADKKTEETTLLEDRILTTRHGTTTSTTQSSVGVTFGYADADSFRPGPNTSGLETRVQQAERFFKEKLFDWTSDKPFGTLYVLELPKDHKGIYGKLTDSYTYMRNGWDVQVSATSTQFNGGSLLVAMVPELCSLKAREEFQLTLYPHQFINPRTNTTAHIQVPYLGVNRHDQGKRHQAWSLVVMVLTPLTTEAQMNSGTVEVYANIAPTNVVVAGELPGKQGIIPVAAADGYGGFQNTDPKTADPIYGHVYNPSRNDCHGRYSNLMDVAEACPTLLNFDGKPYVVTKNNGDKVMARFDVAFTHKVHGNTFLAGLADYYTQYSGSLNYHFMYTGPTHHKAKFMVAYVPPGVAVDQLPSTPEDAAHCYHAEWDTGLNSSFSFAVPYISAADFSYTHTDTPAMATTNGWVVVLQVTDTHSAEAAVVVSVSAGPDLEFRFPIDPVRQTTSAGEGADVVTTDPSTHGGNVQEGRRKHTDVAFLLDRSTHVHTNKTSFVVDLMDTREKALVGAILRASTYYFCDLEIACVGDHTRVFWQPNGAPRTTQLGDNPMVFAKGGVTRFAIPFTAPHRLLSTVYNGECVYTKAAAAIRGDRAALAAKYADTNHTLPPTFNFGYVTVDKPVDVYYRMKRAELYCPRPLLPAYKHTDRDRFDAPIGVERQTLNFDLLKLAGDVESNPGP

SEQ ID NO: 385 - DNA, 2277 bp, Artificial Sequence
  P1_SAT3_ZIM/05/91_cut_sites_removed
ggagcgggccagtcttcccctgccactgggtcgcagaaccaatctggcaacactggcagcatcataaacaactactacatgcagcagtaccaaaattcaatggacacccagcttggcgacaacgccatctcgggtggttcaaatgaaggcagcacggacaccacgtccacacacaccaacaacacccaaaacaatgattggttttcaaaattggcccaatccgccatttcaggactcttcggggctctgttggcggacaaaaagaccgaggaaacaaccttgcttgaggaccgaatcctcacaacacgccacaatactaccacatccaccacgcagagttcggtgggagtgacttacggttatgcgtccgctgatcggtttctcccaggaccgaacacaagtgggctggaaacgcgagtggaacaggccgagagattcttcaaggagagactcttcacttggaccgcttcgcagcagtacgcccacgttcacctgcttgaacttcccaccgaccacaagggcatctacggtgcaatggtggacaaccacgcttacatacgcaacggatgggacgtgcaggtctccgcgaccagcacgcagttcaatggtggtacattgctcgtggcaatggtcccagagttacacgcgctcgacacacgtagtgtttcacagctcacgctgtttccacaccaattcatcaacccacgcacaaacaccactgcccacattgtcgttccctacattggggtaaacaggcatgaccaggtaaaaatgcacaaggcctggacattggtggtcgcggttctcgcaccgctcacaacatcaaacatgggacaggacaacgttgaggtgtacgccaacatcgcaccaaccaacgtttttgttgctggcgagaagcctaccaaacaaggcatcttccccgtggcctgcaacgacggctacggtggctttcagaacactgatcccaagacctctgaccccatatacgggcttgtggcaaacccacctcgcaccgcttttccagggaggttcaccaacttccttgacgtggcggaggcatgcccgacctttctggacttcaacggaacaccttacgtcaagaccagacacaacagtgggagcaagatactcacccacatagatttggcttttgggcacaagagtttcaagaacacttatcttgctggtctcgcccagtattacgcccaatacagcggatctctcaacctgcacttcatgtacacgggtccaacgcaatcaaaggcacgctttatggttgcatacgtaccaccagggacggagcccgtaccatcaacacccgaggaagcggcgcactgctaccactcggaatgggacactggactgaactccaagttcacgttcacagtgccgtacatgtctgctgctgactatgcctacacctactgcgacgagcctgaacaggcctccgcacaagggtgggtaacactgtaccaaattactgacacacatgaccctgattcggctgtcctcatctcagttagcgcaggcgctgactttgaactcaggctgcccatcaaccccgttactcagacaacgagcgcgggggaaggcgcagacgtggtgacaacggacgttaccacacatggaggaacagttgacacaccaagaaggcagcacaccaacgtggagtttctgctggacagattcacacacattgggtcgatcaccgcctcaaagaccattgacctccttgagacaaaagaacacacgctggtgggcgcactcctgcgttcagctacgtactacttttgtgaccttgaggtcgcggtgcttggcaacgcgaagtgggttggatgggtgccgaatggctgcccacacaccgaccgcgtggaagacaacccagtcgttcacgccaaggggaatgttacccgctttgcactgccctacacagccccgcacggagtgcttgccacgacctacaacgggacttgcaagtattccaagacgcaaagtgttaaaccacgccgaggcgacatggctgtgctggcacaacgtgttgaaggtgaacaacaaagatgcaaacccacgacattcaacttcggtcgattgttgtgtgattcgggtgacgtgtactaccgaatgaagcgggccgagctttactgcccacgtccgctgatggtcaggtacactcacaccacagacagatacaaagttgcgcttgtgtcaccagctaagcaactgtgcaacttcgacctgttaaagttggctggagatgttgagtccaaccctgggccc

SEQ ID NO: 386 - DNA, 2277 bp, Foot-and-mouth disease virus
  CDS (1)..(2277)
  misc_feature (1)..(2277): P1_SAT3_ZIM/05/91_wildtype
ggagcgggccagtcttcccctgccacagggtcgcagaaccaatctggcaacactggcagcatcataaacaactactacatgcagcagtaccagaattcaatggacacccagcttggcgacaacgccatctcgggtggttcaaatgaaggcagcacggacaccacgtccacacacaccaacaacacccaaaacaatgattggttttcaaaattggcccaatccgccatttcaggactcttcggggctctgttggcggacaaaaagaccgaggaaacaaccttgctcgaggaccgaatcctcacaacacgccacaatactaccacatccaccacgcagagttcggtgggagtgacgtacggttacgcgtccgctgaccggtttctcccaggaccgaacacaagtgggctggaaacgcgagtggaacaggccgagagattcttcaaggagagactcttcacttggaccgcttcgcagcagtacgcccacgttcacctgcttgaacttcccaccgaccacaagggcatctacggtgccatggtggacaaccacgcgtacatacgcaacggatgggacgtgcaggtctccgcgaccagcacgcagttcaatggtggtacattgctcgtggcaatggtcccagagttacacgcgctcgacacgcgtagtgtttcacagctcacgctgtttccacaccaattcatcaacccacgcacaaacaccactgcccacattgtggttccctacattggggtaaacaggcatgaccaggtaaaaatgcacaaggcctggacattggtggtcgcggttctcgcaccgctcaccacatcaaacatgggacaggacaacgttgaggtgtacgccaacatcgcaccaaccaacgtttttgtggctggcgagaagcctaccaaacaaggcatcttccccgtggcctgcaacgacggctacggtggctttcagaacactgatcccaagacctctgaccccatatacgggctggtggcaaacccacctcgcaccgcttttcccgggaggttcaccaacttcctggacgtggcggaggcatgcccgacctttctggacttcaacggaacaccttacgtcaagaccagacacaacagtgggagcaagatactcacccacatagatttggcttttgggcacaagagtttcaagaacacttatcttgctggtctcgcccagtattacgcccaatacagtggatctctcaacctgcacttcatgtacacgggtcccacgcaatcaaaggcacgctttatggttgcatacgtaccacccgggacggagcccgtaccatcaacacccgaggaagcggcgcactgctaccactcggaatgggacactggactgaactccaagttcacgttcacagtgccgtacatgtctgcagctgactatgcctacacctactgcgacgagcctgaacaggcctccgcacaagggtgggtaacactgtaccaaattactgacacacatgaccctgattcggctgtcctcatctcagttagcgcaggcgctgactttgagctcaggctgcccatcaaccccgttactcagacaacgagcgcgggggaaggcgcagacgtggtgaccacggacgttaccacccatggaggaacagttgacacaccaagaaggcagcacaccaacgtggagtttctgctggacagattcacacacattgggtcgatcaccgcctcaaagaccattgacctcctcgagacaaaagaacacacgctggtgggcgcactcctgcgttcagctacgtactacttttgtgacctcgaggtcgcggtgcttggcaacgcgaagtgggttggatgggtgccgaatggctgcccacacaccgaccgcgtggaagacaacccagtcgttcacgccaaggggaatgttacccgctttgcactgccctacacagccccgcacggagtgcttgccacgacctacaacgggacttgcaagtattccaagacgcaaagtgttaaaccacgccgtggcgacatggctgtgctggcacaacgcgttgaaggtgaacaacaaagatgcaaacccacgacattcaacttcggtcgattgttgtgtgattcgggtgacgtgtactaccgaatgaagcgggccgagctttactgcccacgtccgctgatggtcaggtacactcacaccacagacagatacaaagttgcgcttgtgtcaccagctaagcaactgtgcaacttcgacctgttaaagttggctggagatgttgagtccaaccctgggccc

SEQ ID NO: 387 - protein, 759 aa, Foot-and-mouth disease virus
GAGQSSPATGSQNQSGNTGSIINNYYMQQYQNSMDTQLGDNAISGGSNEGSTDTTSTHTNNTQNNDWFSKLAQSAISGLFGALLADKKTEETTLLEDRILTTRHNTTTSTTQSSVGVTYGYASADRFLPGPNTSGLETRVEQAERFFKERLFTWTASQQYAHVHLLELPTDHKGIYGAMVDNHAYIRNGWDVQVSATSTQFNGGTLLVAMVPELHALDTRSVSQLTLFPHQFINPRTNTTAHIVVPYIGVNRHDQVKMHKAWTLVVAVLAPLTTSNMGQDNVEVYANIAPTNVFVAGEKPTKQGIFPVACNDGYGGFQNTDPKTSDPIYGLVANPPRTAFPGRFTNFLDVAEACPTFLDFNGTPYVKTRHNSGSKILTHIDLAFGHKSFKNTYLAGLAQYYAQYSGSLNLHFMYTGPTQSKARFMVAYVPPGTEPVPSTPEEAAHCYHSEWDTGLNSKFTFTVPYMSAADYAYTYCDEPEQASAQGWVTLYQITDTHDPDSAVLISVSAGADFELRLPINPVTQTTSAGEGADVVTTDVTTHGGTVDTPRRQHTNVEFLLDRFTHIGSITASKTIDLLETKEHTLVGALLRSATYYFCDLEVAVLGNAKWVGWVPNGCPHTDRVEDNPVVHAKGNVTRFALPYTAPHGVLATTYNGTCKYSKTQSVKPRRGDMAVLAQRVEGEQQRCKPTTFNFGRLLCDSGDVYYRMKRAELYCPRPLMVRYTHTTDRYKVALVSPAKQLCNFDLLKLAGDVESNPGP

SEQ ID NO: 388 - DNA, 6674 bp, Artificial Sequence
  pJJP_O1P1-3C(C163A)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctacgctggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 389 - DNA, 6674 bp, Artificial Sequence
  pJJP_O1P1-3C(D123P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgcccccgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 390 - DNA, 6674 bp, Artificial Sequence
  pJJP_O1P1-3C(G125P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttccgagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 391 - DNA, 6674 bp, Artificial Sequence
  pJJP_O1P1-3C(I128P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgcctttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 392 - DNA, 6674 bp, Artificial Sequence
  pJJP_O1P1-3C(I22P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcccccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 393 - DNA, 6674 bp, Artificial Sequence
  pJJP_O1P1-3C(I22P/L127P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcccccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 394 - DNA, 6674 bp, Artificial Sequence
  pJJP_O1P1-3C(I22P/T100P/L127P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcccccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 395 - DNA, 6674 bp, Artificial Sequence
  pJJP_O1P1-3C(I22P/T100P/V124P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcccccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccgaaacactttcgtgatacagcaagaatgaagaaaggtacccccgttgtcggcgtgatcaacaacgccgaccctgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 396 - DNA, 6674 bp, Artificial Sequence
  pJJP_O1P1-3C(I99P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagaccccacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 397 - DNA, 6674 bp, Artificial Sequence
  pJJP_O1P1-3C(L127P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 398 - DNA, 6674 bp, Artificial Sequence
  pJJP_O1P1-3C(L23P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccctgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 399 - DNA, 6674 bp, Artificial Sequence
  pJJP_O1P1-3C(R126P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggccactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 400 - DNA, 6674 bp, Artificial Sequence
  pJJP_O1P1-3C(T100P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 401 - DNA, 6674 bp, Artificial Sequence
  pJJP_O1P1-3C(T100P/L127P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 402 - DNA, 6674 bp, Artificial Sequence
  pJJP_O1P1-3C(T34A/M88L)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccgccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcctggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 403 - DNA, 6674 bp, Artificial Sequence
  pJJP_O1P1-3C(V124P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgaccctgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 404 - DNA, 6674 bp, Artificial Sequence
  pJJP_O1P1-3C(V124P/L127P)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgaccctgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 405 - DNA, 6674 bp, Artificial Sequence
  pJJP_O1P1-3C(WT)-GLuc(-1M)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagattaaacttaagtgactctattaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagaatcgatattggatccgccgccaccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggctagctccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgaattcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctaggacccagactacctccgcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgaggaattccacaagcaaaagatcattgcaccagcaaagcagcttctgaattttgacctgctcaagttggccggagacgttgagtccaacccaggaccaggagtcaaagttctgtttgccctgatctgcatcgctgtggccgaggccaagcccaccgagaacaacgaagacttcaacatcgtggccgtggccagcaacttcgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaaatgcacgcccaagatgaagaagttcatcccaggacgctgccacacctacgaaggcgacaaagagtccgcacagggcggcataggcgaggcgatcgttgacattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaatctagagatatcagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgtcgactggctgcagtcggggaaatgtgcgcggaacccctatttgtttatttttctaaatacattcaaatatgtatccgctctcgagacaataaccctgataaatgcttcaataatattgaaaaaggaagagtatgagtattcaacatttcagagtggcccttattcccttttttgcagcattttgccttcctgtttttgctcacccagaaacactggtgaaagtaaaagatgctgaagaccagttgggtgccagagtgggttacattgaactggacctcaacagtggtaaaatccttgagagttttagacctgaagaaagatttccaatgatgagcacttttaaagtactgctatgtggtgctgtattatccagaattgatgcagggcaagagcaacttggtagaagaatacactattctcagaatgacttggttgagtactcaccagtcacagaaaagcatcttacagatggcatgacagtaagagaattatgcagtgctgccataaccatgagtgataacacagctgccaacttacttctgacaaccattggtggacctaaagagctaactgcttttttgcacaacatgggggaccatgtaactagacttgataggtgggaacctgagctgaatgaagccattccaaatgatgagagggacaccacaatgcctgtagcaatggcaacaactttgaggaaactattaactggtgaactacttactctagcttccagacaacaattaatagactggatggaggcagataaagttgcaggaccacttctgaggtcagccttacctgctggctggtttattgctgataaatctggagcaggtgagagagggtctaggggtatcattgcagcactggggccagatggtaagccctccagaattgtagttatctacacaacagggagtcaggcaactatggatgaaagaaatagacagatagctgagataggtgcctcactgattaagcattggtgagcatgcgaccaagtttactcatatatactttagattgatttaaaacttcatttttaatttaaaaggatctaggtgaagatcctttttgataatctcatgaccaaaatcccttaacgtgagttttcgttccactgagcggttaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttccactgcaatggccggccagatct

SEQ ID NO: 406 - DNA, 6531 bp, Artificial Sequence
  pSNAP_3C(L23P)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatgagtggtgccccaccgaccgacttgcaaaagatggtcatgagcaacactaagcctgttgagctcatccctgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 407 - DNA, 6531 bp, Artificial Sequence
  pSNAP_3C(L42H)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatgagtggtgccccaccgaccgacttgcaaaagatggtcatgagcaacactaagcctgttgagctcatccttgacggtaagacggtggccatctgctgcgccaccggagtgtttggtactgcctaccacgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 408 - DNA, 6531 bp, Artificial Sequence
  pSNAP_3C(T100P)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcccgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 409 - DNA, 6531 bp, Artificial Sequence
  pSNAP_3C(WT)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 410 - DNA, 6590 bp, Artificial Sequence
  pSNAP_Flag-3C(L127P)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatggactataaagacgacgacgacaaacccgggagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagtcgacagacaagcttaggtatttattcggctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 411 - DNA, 627 bp, Bovine rhinitis
  CDS (1)..(627)
  misc_feature (1)..(627): Bovine_Rhinitis_A_Sd-1_KP236128_3C(C23P)
  misc_feature (69)..(69): n is c, g, a, t/u
agtggtgctccaccaacagacatgcagcaacacgttctcaggaacgtgcgcccaatatcacttgttccngatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgacaatgcacttcagagatgaagtacgcattcccaaggggacaactgttgcaggctgtgtgaacagtcacgagtttgggcgcttggtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 412 - protein, 209 aa, Bovine rhinitis
SGAPPTDMQQHVLRNVRPISLVPDGKVVSMCCGFGVFGNCYLVPNHMFEETFDTILLGETPLKKKDYEVINLETGDGVSDAALLHVFKGPRVKDMTMHFRDEVRIPKGTTVAGCVNSHEFGRLVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 413 - DNA, 627 bp, Bovine rhinitis
  CDS (1)..(627)
  misc_feature (1)..(627): Bovine_Rhinitis_A_Sd-1_KP236128_3C(F120P)
  misc_feature (360)..(360): n is c, g, a, t/u
agtggtgctccaccaacagacatgcagcaacacgttctcaggaacgtgcgcccaatatcacttgtttgtgatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgacaatgcacttcagagatgaagtacgcattcccaaggggacaactgttgcaggctgtgtgaacagtcacgagccngggcgcttggtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 414 - protein, 209 aa, Bovine rhinitis
SGAPPTDMQQHVLRNVRPISLVCDGKVVSMCCGFGVFGNCYLVPNHMFEETFDTILLGETPLKKKDYEVINLETGDGVSDAALLHVFKGPRVKDMTMHFRDEVRIPKGTTVAGCVNSHEPGRLVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 415 - DNA, 627 bp, Bovine rhinitis
  CDS (1)..(627)
  misc_feature (1)..(627): Bovine_Rhinitis_A_Sd-1_KP236128_3C(L123P)
  misc_feature (369)..(369): n is c, g, a, t/u
agtggtgctccaccaacagacatgcagcaacacgttctcaggaacgtgcgcccaatatcacttgtttgtgatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgacaatgcacttcagagatgaagtacgcattcccaaggggacaactgttgcaggctgtgtgaacagtcacgagtttgggcgcccngtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 416 - protein, 209 aa, Bovine rhinitis
SGAPPTDMQQHVLRNVRPISLVCDGKVVSMCCGFGVFGNCYLVPNHMFEETFDTILLGETPLKKKDYEVINLETGDGVSDAALLHVFKGPRVKDMTMHFRDEVRIPKGTTVAGCVNSHEFGRPVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 417 - DNA, 627 bp, Bovine rhinitis
  CDS (1)..(627)
  misc_feature (1)..(627): Bovine_Rhinitis_A_Sd-1_KP236128_3C(T96P)
  misc_feature (288)..(288): n is c, g, a, t/u
agtggtgctccaccaacagacatgcagcaacacgttctcaggaacgtgcgcccaatatcacttgtttgtgatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgccnatgcacttcagagatgaagtacgcattcccaaggggacaactgttgcaggctgtgtgaacagtcacgagtttgggcgcttggtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 418 - protein, 209 aa, Bovine rhinitis
SGAPPTDMQQHVLRNVRPISLVCDGKVVSMCCGFGVFGNCYLVPNHMFEETFDTILLGETPLKKKDYEVINLETGDGVSDAALLHVFKGPRVKDMPMHFRDEVRIPKGTTVAGCVNSHEFGRLVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 419 - DNA, 627 bp, Bovine rhinitis
  CDS (1)..(627)
  misc_feature (1)..(627): Bovine_Rhinitis_A_Sd-1_KP236128_3C(V22P)
  misc_feature (66)..(66): n is c, g, a, t/u
agtggtgctccaccaacagacatgcagcaacacgttctcaggaacgtgcgcccaatatcacttccntgtgatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgacaatgcacttcagagatgaagtacgcattcccaaggggacaactgttgcaggctgtgtgaacagtcacgagtttgggcgcttggtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 420 - protein, 209 aa, Bovine rhinitis
SGAPPTDMQQHVLRNVRPISLPCDGKVVSMCCGFGVFGNCYLVPNHMFEETFDTILLGETPLKKKDYEVINLETGDGVSDAALLHVFKGPRVKDMTMHFRDEVRIPKGTTVAGCVNSHEFGRLVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 421 - DNA, 627 bp, Bovine rhinitis
  CDS (1)..(627)
  misc_feature (1)..(627): Bovine_Rhinitis_A_Sd-1_KP236128_3C(wt)
agtggtgctccaccaacagacatgcagcaacacgttctcaggaacgtgcgcccaatatcacttgtttgtgatggaaaggttgtgtctatgtgctgtggctttggggtttttggcaactgttaccttgtgccaaaccatatgtttgaggagacttttgacacaattttgttgggggagactcccctgaagaagaaggattacgaggttattaacctcgaaacaggcgatggtgtttctgatgcagcactgttgcatgtttttaaaggccccagagttaaggacatgacaatgcacttcagagatgaagtacgcattcccaaggggacaactgttgcaggctgtgtgaacagtcacgagtttgggcgcttggtttttactggtaccgcccttacatttaaagatgtgattgtgtgttcagacggtgatgagcttccgaacgtgtttgcctacaaagctgccacacaacggggctactgtggcagtcccgttttagtgaagaacagtgcgcacacagtggtggttgggattcactctgcaggtgggaacggaaacgggtacgcgtcgtgtgtcacccgatctgtcctgttgaaggttaagagaatgcttgatcctgatgtccatcttgag

SEQ ID NO: 422 - protein, 209 aa, Bovine rhinitis
SGAPPTDMQQHVLRNVRPISLVCDGKVVSMCCGFGVFGNCYLVPNHMFEETFDTILLGETPLKKKDYEVINLETGDGVSDAALLHVFKGPRVKDMTMHFRDEVRIPKGTTVAGCVNSHEFGRLVFTGTALTFKDVIVCSDGDELPNVFAYKAATQRGYCGSPVLVKNSAHTVVVGIHSAGGNGNGYASCVTRSVLLKVKRMLDPDVHLE

SEQ ID NO: 423 - DNA, 624 bp, Bovine rhinitis
  CDS (1)..(624)
  misc_feature (1)..(624): Bovine_Rhinitus_B_3C(L124P)
  misc_feature (372)..(372): n is c, g, a, t/u
agtgggaaccctccaactgacatgcagttggtggtactcaagaacacacaaccaatttcactagttagagatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattacctcacactttcgagacgaggtcaaggtcactaagaattcaccagttgtcggttgtgtcaagaacacaacggtcggtcaaccngtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 424 - protein, 208 aa, Bovine rhinitis
SGNPPTDMQLVVLKNTQPISLVRDGQIVATCCALGVFGTTYLVPYHLFEESFDTLIIGDRHLKEQDYKLDTFELRDGKISDVAALTLNKGARVRDITSHFRDEVKVTKNSPVVGCVKNTTVGQPVFNGTAAGFKDHIICSDGDTLPNMFVYTANTQYGYCGSGILVKDGSHTVIIGIHSAGGNGKGYASCVTRSALLALRGRERPELE

SEQ ID NO: 425 - DNA, 624 bp, Bovine rhinitis
  CDS (1)..(624)
  misc_feature (1)..(624): Bovine_Rhinitus_B_3C(R23P)
  misc_feature (69)..(69): n is c, g, a, t/u
agtgggaaccctccaactgacatgcagttggtggtactcaagaacacacaaccaatttcactagttccngatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattacctcacactttcgagacgaggtcaaggtcactaagaattcaccagttgtcggttgtgtcaagaacacaacggtcggtcaactggtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 426 - protein, 208 aa, Bovine rhinitis
SGNPPTDMQLVVLKNTQPISLVPDGQIVATCCALGVFGTTYLVPYHLFEESFDTLIIGDRHLKEQDYKLDTFELRDGKISDVAALTLNKGARVRDITSHFRDEVKVTKNSPVVGCVKNTTVGQLVFNGTAAGFKDHIICSDGDTLPNMFVYTANTQYGYCGSGILVKDGSHTVIIGIHSAGGNGKGYASCVTRSALLALRGRERPELE

SEQ ID NO: 427 - DNA, 624 bp, Bovine rhinitis
  CDS (1)..(624)
  misc_feature (1)..(624): Bovine_Rhinitus_B_3C(T97P)
  misc_feature (291)..(291): n is c, g, a, t/u
agtgggaaccctccaactgacatgcagttggtggtactcaagaacacacaaccaatttcactagttagagatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattccntcacactttcgagacgaggtcaaggtcactaagaattcaccagttgtcggttgtgtcaagaacacaacggtcggtcaactggtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 428 - protein, 208 aa, Bovine rhinitis
SGNPPTDMQLVVLKNTQPISLVRDGQIVATCCALGVFGTTYLVPYHLFEESFDTLIIGDRHLKEQDYKLDTFELRDGKISDVAALTLNKGARVRDIPSHFRDEVKVTKNSPVVGCVKNTTVGQLVFNGTAAGFKDHIICSDGDTLPNMFVYTANTQYGYCGSGILVKDGSHTVIIGIHSAGGNGKGYASCVTRSALLALRGRERPELE

SEQ ID NO: 429 - DNA, 624 bp, Bovine rhinitis
  CDS (1)..(624)
  misc_feature (1)..(624): Bovine_Rhinitus_B_3C(V121P)
  misc_feature (363)..(363): n is c, g, a, t/u
agtgggaaccctccaactgacatgcagttggtggtactcaagaacacacaaccaatttcactagttagagatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattacctcacactttcgagacgaggtcaaggtcactaagaattcaccagttgtcggttgtgtcaagaacacaacgccnggtcaactggtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 430 - protein, 208 aa, Bovine rhinitis
SGNPPTDMQLVVLKNTQPISLVRDGQIVATCCALGVFGTTYLVPYHLFEESFDTLIIGDRHLKEQDYKLDTFELRDGKISDVAALTLNKGARVRDITSHFRDEVKVTKNSPVVGCVKNTTPGQLVFNGTAAGFKDHIICSDGDTLPNMFVYTANTQYGYCGSGILVKDGSHTVIIGIHSAGGNGKGYASCVTRSALLALRGRERPELE

SEQ ID NO: 431 - DNA, 624 bp, Bovine rhinitis
  CDS (1)..(624)
  misc_feature (1)..(624): Bovine_Rhinitus_B_3C(V22P)
  misc_feature (66)..(66): n is c, g, a, t/u
agtgggaaccctccaactgacatgcagttggtggtactcaagaacacacaaccaatttcactaccnagagatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattacctcacactttcgagacgaggtcaaggtcactaagaattcaccagttgtcggttgtgtcaagaacacaacggtcggtcaactggtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 432 - protein, 208 aa, Bovine rhinitis
SGNPPTDMQLVVLKNTQPISLPRDGQIVATCCALGVFGTTYLVPYHLFEESFDTLIIGDRHLKEQDYKLDTFELRDGKISDVAALTLNKGARVRDITSHFRDEVKVTKNSPVVGCVKNTTVGQLVFNGTAAGFKDHIICSDGDTLPNMFVYTANTQYGYCGSGILVKDGSHTVIIGIHSAGGNGKGYASCVTRSALLALRGRERPELE

SEQ ID NO: 433 - DNA, 624 bp, Bovine rhinitis
  CDS (1)..(624)
  misc_feature (1)..(624): Bovine_Rhinitus_B_3C(wt)
agtgggaaccctccaactgacatgcagttggtggtactcaagaacacacaaccaatttcactagttagagatggacaaattgtcgccacttgttgtgctcttggcgtttttggaaccacctatttagttccctaccacctctttgaagaaagttttgacaccctcattataggagacagacatctgaaagaacaagactacaaacttgacacttttgaactcagagacgggaaaatcagcgatgttgctgccctcaccttaaacaaaggagcccgtgtgcgtgacattacctcacactttcgagacgaggtcaaggtcactaagaattcaccagttgtcggttgtgtcaagaacacaacggtcggtcaactggtatttaacgggacagctgctggttttaaagaccatatcatctgctctgatggtgacactctgcctaatatgttcgtttacactgccaacacacagtacgggtattgcggaagcggcatactcgtcaaagatggttctcacacagtcatcataggcatccatagtgcaggaggtaacggaaaaggttacgctagttgtgtcactcgttccgcactcctcgcactgaggggcagagaaaggcccgagctcgaa

SEQ ID NO: 434 - protein, 208 aa, Bovine rhinitis
SGNPPTDMQLVVLKNTQPISLVRDGQIVATCCALGVFGTTYLVPYHLFEESFDTLIIGDRHLKEQDYKLDTFELRDGKISDVAALTLNKGARVRDITSHFRDEVKVTKNSPVVGCVKNTTVGQLVFNGTAAGFKDHIICSDGDTLPNMFVYTANTQYGYCGSGILVKDGSHTVIIGIHSAGGNGKGYASCVTRSALLALRGRERPELE

SEQ ID NO: 435 - DNA, 615 bp, Equine Rhinitus
  CDS (1)..(615)
  misc_feature (1)..(615): Equine_Rhinitus_A_3C(A125P)
  misc_feature (375)..(375): n is c, g, a, t/u
actggagttccagcaactgatttgcaacaatctattatgaagaatgttcagccaattgagctttattgtgatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattgttcatcttttcacaaatgaaattgagttaaaaaagatgacccaaattacaggaattatgaattctccacaccaaccncgcactgtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 436 - protein, 205 aa, Equine Rhinitus
TGVPATDLQQSIMKNVQPIELYCDGNLVTDCSALGVYDNSYLVPLHLFEFDFDTIVLGGRQYKKADCEKVEFELEINGDMVSSDACLLRVPTGPKVRNIVHLFTNEIELKKMTQITGIMNSPHQPRTVFFGSFLTVKKSILTSDGTVMPNVLSYAAQTSRGYCGAAIVAGSPARIIGIHSAGTGSVAFCSLVSRDALERTLPQKQ

SEQ ID NO: 437 - DNA, 615 bp, Equine rhinitis
  CDS (1)..(615)
  misc_feature (1)..(615): Equine_Rhinitus_A_3C(C23P)
  misc_feature (69)..(69): n is c, g, a, t/u
actggagttccagcaactgatttgcaacaatctattatgaagaatgttcagccaattgagctttatccngatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattgttcatcttttcacaaatgaaattgagttaaaaaagatgacccaaattacaggaattatgaattctccacaccaagcacgcactgtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 438 - protein, 205 aa, Equine rhinitis
TGVPATDLQQSIMKNVQPIELYPDGNLVTDCSALGVYDNSYLVPLHLFEFDFDTIVLGGRQYKKADCEKVEFELEINGDMVSSDACLLRVPTGPKVRNIVHLFTNEIELKKMTQITGIMNSPHQARTVFFGSFLTVKKSILTSDGTVMPNVLSYAAQTSRGYCGAAIVAGSPARIIGIHSAGTGSVAFCSLVSRDALERTLPQKQ

SEQ ID NO: 439 - DNA, 615 bp, Equine Rhinitus
  CDS (1)..(615)
  misc_feature (1)..(615): Equine_Rhinitus_A_3C(T127P)
  misc_feature (381)..(381): n is c, g, a, t/u
actggagttccagcaactgatttgcaacaatctattatgaagaatgttcagccaattgagctttattgtgatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattgttcatcttttcacaaatgaaattgagttaaaaaagatgacccaaattacaggaattatgaattctccacaccaagcacgcccngtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 440 - protein, 205 aa, Equine Rhinitus
TGVPATDLQQSIMKNVQPIELYCDGNLVTDCSALGVYDNSYLVPLHLFEFDFDTIVLGGRQYKKADCEKVEFELEINGDMVSSDACLLRVPTGPKVRNIVHLFTNEIELKKMTQITGIMNSPHQARPVFFGSFLTVKKSILTSDGTVMPNVLSYAAQTSRGYCGAAIVAGSPARIIGIHSAGTGSVAFCSLVSRDALERTLPQKQ

SEQ ID NO: 441 - DNA, 615 bp, Equine Rhinitus
  CDS (1)..(615)
  misc_feature (1)..(615): Equine_Rhinitus_A_3C(V100P)
  misc_feature (300)..(300): n is c, g, a, t/u
actggagttccagcaactgatttgcaacaatctattatgaagaatgttcagccaattgagctttattgtgatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattccncatcttttcacaaatgaaattgagttaaaaaagatgacccaaattacaggaattatgaattctccacaccaagcacgcactgtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 442 - protein, 205 aa, Equine Rhinitus
TGVPATDLQQSIMKNVQPIELYCDGNLVTDCSALGVYDNSYLVPLHLFEFDFDTIVLGGRQYKKADCEKVEFELEINGDMVSSDACLLRVPTGPKVRNIPHLFTNEIELKKMTQITGIMNSPHQARTVFFGSFLTVKKSILTSDGTVMPNVLSYAAQTSRGYCGAAIVAGSPARIIGIHSAGTGSVAFCSLVSRDALERTLPQKQ

SEQ ID NO: 443 - DNA, 615 bp, Equine Rhinitus
  CDS (1)..(615)
  misc_feature (1)..(615): Equine_Rhinitus_A_3C(wt)
actggagttccagcaactgatttgcaacaatctattatgaagaatgttcagccaattgagctttattgtgatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattgttcatcttttcacaaatgaaattgagttaaaaaagatgacccaaattacaggaattatgaattctccacaccaagcacgcactgtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 444 - protein, 205 aa, Equine Rhinitus
TGVPATDLQQSIMKNVQPIELYCDGNLVTDCSALGVYDNSYLVPLHLFEFDFDTIVLGGRQYKKADCEKVEFELEINGDMVSSDACLLRVPTGPKVRNIVHLFTNEIELKKMTQITGIMNSPHQARTVFFGSFLTVKKSILTSDGTVMPNVLSYAAQTSRGYCGAAIVAGSPARIIGIHSAGTGSVAFCSLVSRDALERTLPQKQ

SEQ ID NO: 445 - DNA, 615 bp, Equine Rhinitus
  CDS (1)..(615)
  misc_feature (1)..(615): Equine_Rhinitus_A_3C(Y22P)
  misc_feature (66)..(66): n is c, g, a, t/u
actggagttccagcaactgatttgcaacaatctattatgaagaatgttcagccaattgagcttccntgtgatggtaatttggttactgattgttctgctttgggtgtttatgataactcctatttggttcccttgcatttgtttgagtttgattttgacaccattgtgcttggcggtcgccagtacaagaaagctgattgtgaaaaagtggaatttgaacttgaaattaatggagatatggtgtcatcggacgcgtgcttgctccgggttccaaccggaccaaaagtgagaaatattgttcatcttttcacaaatgaaattgagttaaaaaagatgacccaaattacaggaattatgaattctccacaccaagcacgcactgtgttttttggcagttttttgacagtaaaaaaatctattttgacatcagatgggactgttatgcctaatgtcttgtcttacgcagcccagacctcgcgggggtattgtggcgcagcaattgtggcaggctcacctgcccgcatcattggcattcattctgctggtactgggtctgtagccttttgctccctggtgtccagagatgcgctggagcgcactctccctcagaaacag

SEQ ID NO: 446 - protein, 205 aa, Equine Rhinitus
TGVPATDLQQSIMKNVQPIELPCDGNLVTDCSALGVYDNSYLVPLHLFEFDFDTIVLGGRQYKKADCEKVEFELEINGDMVSSDACLLRVPTGPKVRNIVHLFTNEIELKKMTQITGIMNSPHQARTVFFGSFLTVKKSILTSDGTVMPNVLSYAAQTSRGYCGAAIVAGSPARIIGIHSAGTGSVAFCSLVSRDALERTLPQKQ

SEQ ID NO: 447 - DNA, 549 bp, Human coxsackievirus
  CDS (1)..(549)
  misc_feature (1)..(549): Human_Coxsackievirus_A1_Tompkins_3C(F109P)
  misc_feature (327)..(327): n is c, g, a, t/u
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacacctccaaaccnccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 448 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIRTHLPTQIHETNDAVLAVNTSKPPNMYIPVGSVVEQGMLNLGGRPTNRTLMYNFPTKAGQCGGVLMATGKVIGIHVGGNGSHGFAAALKRSYFTEEQ

SEQ ID NO: 449 - DNA, 549 bp, Human coxsackievirus
  CDS (1)..(549)
  misc_feature (1)..(549): Human_Coxsackievirus_A1_Tompkins_3C(L102P)
  misc_feature (306)..(306): n is c, g, a, t/u
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttccngctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 450 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIRTHLPTQIHETNDAVPAVNTSKFPNMYIPVGSVVEQGMLNLGGRPTNRTLMYNFPTKAGQCGGVLMATGKVIGIHVGGNGSHGFAAALKRSYFTEEQ

SEQ ID NO: 451 - DNA, 549 bp, Human coxsackievirus
  CDS (1)..(549)
  misc_feature (1)..(549): Human_Coxsackievirus_A1_Tompkins_3C(N105P)
  misc_feature (315)..(315): n is c, g, a, t/u
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcccnacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 452 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIRTHLPTQIHETNDAVLAVPTSKFPNMYIPVGSVVEQGMLNLGGRPTNRTLMYNFPTKAGQCGGVLMATGKVIGIHVGGNGSHGFAAALKRSYFTEEQ

SEQ ID NO: 453 - DNA, 549 bp, Human coxsackievirus
  CDS (1)..(549)
  misc_feature (1)..(549): Human_Coxsackievirus_A1_Tompkins_3C(R87P)
  misc_feature (261)..(261): n is c, g, a, t/u
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcccnactcacttaccgacccaaatccatgagaccaatgatgcggttttggctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 454 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIPTHLPTQIHETNDAVLAVNTSKFPNMYIPVGSVVEQGMLNLGGRPTNRTLMYNFPTKAGQCGGVLMATGKVIGIHVGGNGSHGFAAALKRSYFTEEQ

SEQ ID NO: 455 - DNA, 549 bp, Human coxsackievirus
  CDS (1)..(549)
  misc_feature (1)..(549): Human_Coxsackievirus_A1_Tompkins_3C(T106P)
  misc_feature (318)..(318): n is c, g, a, t/u
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacccntccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 456 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIRTHLPTQIHETNDAVLAVNPSKFPNMYIPVGSVVEQGMLNLGGRPTNRTLMYNFPTKAGQCGGVLMATGKVIGIHVGGNGSHGFAAALKRSYFTEEQ

SEQ ID NO: 457 - DNA, 549 bp, Human coxsackievirus
  CDS (1)..(549)
  misc_feature (1)..(549): Human_Coxsackievirus_A1_Tompkins_3C(T19P)
  misc_feature (57)..(57): n is c, g, a, t/u
ggcccagtatttgattatgcagttgcaatggcaaagaaaaacatcctgacagccccnacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 458 - protein, 183 aa, Human coxsackievirus
GPVFDYAVAMAKKNILTAPTEKGEFTMLGVHDRVAVLPTHSNPGETIVVSGKEVKILDAKRLVDNDEVNLEITIVTLDRNEKFRDIRTHLPTQIHETNDAVLAVNTSKFPNMYIPVGSVVEQGMLNLGGRPTNRTLMYNFPTKAGQCGGVLMATGKVIGIHVGGNGSHGFAAALKRSYFTEEQ

SEQ ID NO: 459 - DNA, 549 bp, Human coxsackievirus
  CDS (1)..(549)
  misc_feature (1)..(549): Human_Coxsackievirus_A1_Tompkins_3C(T20P)
  misc_feature (60)..(60): n is c, g, a, t/u
ggcccagtatttgattatgcagttgcaatggcaaagaaaaacatcctgacagccaccccngaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 460 - protein, 183 aa, Human coxsackievirus
GPVFDYAVAMAKKNILTATPEKGEFTMLGVHDRVAVLPTHSNPGETIVVSGKEVKILDAKRLVDNDEVNLEITIVTLDRNEKFRDIRTHLPTQIHETNDAVLAVNTSKFPNMYIPVGSVVEQGMLNLGGRPTNRTLMYNFPTKAGQCGGVLMATGKVIGIHVGGNGSHGFAAALKRSYFTEEQ

SEQ ID NO: 461 - DNA, 549 bp, Human coxsackievirus
  CDS (1)..(549)
  misc_feature (1)..(549): Human_Coxsackievirus_A1_Tompkins_3C(wt)
ggcccagtatttgattatgcagttgcaatggcaaagaaaaacatcctgacagccaccacagaaaagggtgaattcacaatgttaggagtacatgatagagttgcagtattgcctacccattcaaacccaggtgaaacaatagttgtgtcaggaaaagaagtgaagatcttggatgcaaagaggctggttgataatgatgaggtcaatcttgaaattactattgtaaccctagacagaaacgaaaagtttagagacatcagaactcacttaccgacccaaatccatgagaccaatgatgcggttttggctgtcaacacctccaaatttccaaatatgtacattccagttggatcagtagttgaacagggaatgttgaaccttggtggcagacccacaaatagaaccctaatgtataactttccaactaaagcagggcagtgtggtggtgtcttaatggccactggcaaagtgattggcatacatgttggtggtaatggatctcacggtttcgcagctgcacttaaaagaagttactttactgaagaacag

SEQ ID NO: 462 - protein, 183 aa, Human coxsackievirus
GPVFDYAVAMAKKNILTATTEKGEFTMLGVHDRVAVLPTHSNPGETIVVSGKEVKILDAKRLVDNDEVNLEITIVTLDRNEKFRDIRTHLPTQIHETNDAVLAVNTSKFPNMYIPVGSVVEQGMLNLGGRPTNRTLMYNFPTKAGQCGGVLMATGKVIGIHVGGNGSHGFAAALKRSYFTEEQ

SEQ ID NO: 463 - DNA, 549 bp, Human coxsackievirus
  CDS (1)..(549)
  misc_feature (1)..(549): Human_Coxsackievirus_A10_Kowalik_3C(L102P)
  misc_feature (306)..(306): n is c, g, a, t/u
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactccngttatcaacactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 464 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDITKFIPETIAGASDATPVINTEHMPSMFVPIGDVVQYGFLNLSGKPTHRTMMYNFPTKAGQCGGVVTSVGKIIGIHIGGNGRQGFCAGLKRSYFASEQ

SEQ ID NO: 465 - DNA, 549 bp, Human coxsackievirus
  CDS (1)..(549)
  misc_feature (1)..(549): Human_Coxsackievirus_A10_Kowalik_3C(M109P)
  misc_feature (327)..(327): n is c, g, a, t/u
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcaacactgagcatccnccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 466 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDITKFIPETIAGASDATLVINTEHPPSMFVPIGDVVQYGFLNLSGKPTHRTMMYNFPTKAGQCGGVVTSVGKIIGIHIGGNGRQGFCAGLKRSYFASEQ

SEQ ID NO: 467 - DNA, 549 bp, Human coxsackievirus
  CDS (1)..(549)
  misc_feature (1)..(549): Human_Coxsackievirus_A10_Kowalik_3C(N105P)
  misc_feature (315)..(315): n is c, g, a, t/u
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcccnactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 468 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDITKFIPETIAGASDATLVIPTEHMPSMFVPIGDVVQYGFLNLSGKPTHRTMMYNFPTKAGQCGGVVTSVGKIIGIHIGGNGRQGFCAGLKRSYFASEQ

SEQ ID NO: 469 - DNA, 549 bp, Human coxsackievirus
  CDS (1)..(549)
  misc_feature (1)..(549): Human_Coxsackievirus_A10_Kowalik_3C(Q19P)
  misc_feature (57)..(57): n is c, g, a, t/u
ggacctagcttggacttcgctttgtctcttctgaggcgcaacatcagacaagcgccnaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcaacactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 470 - protein, 183 aa, Human coxsackievirus
GPSLDFALSLLRRNIRQAPTDQGHFTMLGIRDRLAILPRHSQPGKTIWIEHKLVNVLDAVELVDEQGVNLELTLVTLDTNEKFRDITKFIPETIAGASDATLVINTEHMPSMFVPIGDVVQYGFLNLSGKPTHRTMMYNFPTKAGQCGGVVTSVGKIIGIHIGGNGRQGFCAGLKRSYFASEQ

SEQ ID NO: 471 - DNA, 549 bp, Human coxsackievirus
  CDS (1)..(549)
  misc_feature (1)..(549): Human_Coxsackievirus_A10_Kowalik_3C(T106P)
  misc_feature (318)..(318): n is c, g, a, t/u
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcaacccngagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 472 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDITKFIPETIAGASDATLVINPEHMPSMFVPIGDVVQYGFLNLSGKPTHRTMMYNFPTKAGQCGGVVTSVGKIIGIHIGGNGRQGFCAGLKRSYFASEQ

SEQ ID NO: 473 - DNA, 549 bp, Human coxsackievirus
  CDS (1)..(549)
  misc_feature (1)..(549): Human_Coxsackievirus_A10_Kowalik_3C(T20P)
  misc_feature (60)..(60): n is c, g, a, t/u
ggacctagcttggacttcgctttgtctcttctgaggcgcaacatcagacaagcgcagccngaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcaacactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 474 - protein, 183 aa, Human coxsackievirus
GPSLDFALSLLRRNIRQAQPDQGHFTMLGIRDRLAILPRHSQPGKTIWIEHKLVNVLDAVELVDEQGVNLELTLVTLDTNEKFRDITKFIPETIAGASDATLVINTEHMPSMFVPIGDVVQYGFLNLSGKPTHRTMMYNFPTKAGQCGGVVTSVGKIIGIHIGGNGRQGFCAGLKRSYFASEQ

SEQ ID NO: 475 - DNA, 549 bp, Human coxsackievirus
  CDS (1)..(549)
  misc_feature (1)..(549): n is c, g, a, t/u
  misc_feature (1)..(549): Human_Coxsackievirus_A10_Kowalik_3C(T87P)
  misc_feature (261)..(261): n is c, g, a, t/u
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattccnaagttcatcccagagacaatagctggtgctagtgatgcaactctagttatcaacactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 476 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDIPKFIPETIAGASDATLVINTEHMPSMFVPIGDVVQYGFLNLSGKPTHRTMMYNFPTKAGQCGGVVTSVGKIIGIHIGGNGRQGFCAGLKRSYFASEQ

SEQ ID NO: 477 - DNA, 549 bp, Human coxsackievirus
  CDS (1)..(549)
  misc_feature (1)..(549): Human_Coxsackievirus_A10_Kowalik_3C(wt)
ggacctagcttggacttcgctttgtctcttctgaggcgcaacatcagacaagcgcagaccgaccagggacacttcaccatgctaggcatacgggaccgtctagccatcttgccacgccactcacaaccagggaagaccatctggatagagcacaaattggtcaacgtactagatgcagttgagttggtggatgagcaaggtgttaatttggaactcacgctggtgaccttggacactaatgagaagtttagggacattaccaagttcatcccagagacaatagctggtgctagtgatgcaactctagttatcaacactgagcatatgccctcgatgtttgtgccaataggtgacgttgtgcagtatgggtttttgaatctcagtggcaaacccacacacagaactatgatgtacaatttccccacgaaagcaggacagtgtgggggggtagtcacttcagttggcaagatcattggaatccacattggcgggaatggacgccagggcttctgcgctggtttaaagaggagctactttgccagcgagcaa

SEQ ID NO: 478 - protein, 183 aa, Human coxsackievirus
GPSLDFALSLLRRNIRQAQTDQGHFTMLGIRDRLAILPRHSQPGKTIWIEHKLVNVLDAVELVDEQGVNLELTLVTLDTNEKFRDITKFIPETIAGASDATLVINTEHMPSMFVPIGDVVQYGFLNLSGKPTHRTMMYNFPTKAGQCGGVVTSVGKIIGIHIGGNGRQGFCAGLKRSYFASEQ

SEQ ID NO: 479 - DNA, 549 bp, Human coxsackievirus
  CDS (1)..(549)
  misc_feature (1)..(549): Human_Coxsackievirus_B1_3C(F109P)
  misc_feature (327)..(327): n is c, g, a, t/u
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattaacaccagcaagccncctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 480 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIRGFLAKEEVEVNEAVLAINTSKPPNMYIPVGQVTEYGFLNLGGTPTKRMLMYNFPTRAGQCGGVLMSTGKVLGIHVGGNGHQGFSAALLKHYFNDEQ

SEQ ID NO: 481 - DNA, 549 bp, Human coxsackievirus
  CDS (1)..(549)
  misc_feature (1)..(549): Human_Coxsackievirus_B1_3C(K19P)
  misc_feature (57)..(57): n is c, g, a, t/u
ggacctgtatttgagtttgccgtagccatgatgaagaggaattcgagcacagtgccnactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattaacaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 482 - protein, 183 aa, Human coxsackievirus
GPVFEFAVAMMKRNSSTVPTEYGEFTMLGIYDRWAVLPRHAKPGPTILMNDQEIGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 483 - DNA, 549 bp, Human coxsackievirus
  CDS (1)..(549)
  misc_feature (1)..(549): Human_Coxsackievirus_B1_3C(L102P)
  misc_feature (306)..(306): n is c, g, a, t/u
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgccngcaattaacaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 484 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIRGFLAKEEVEVNEAVPAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 485 - DNA, 549 bp, Human coxsackievirus
  CDS (1)..(549)
  misc_feature (1)..(549): Human_Coxsackievirus_B1_3C(N105P)
  misc_feature (315)..(315): n is c, g, a, t/u
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattccnaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 486 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIRGFLAKEEVEVNEAVLAIPTSKFPNMYIPVGQVTEYGFLNLGGTPTKRMLMYNFPTRAGQCGGVLMSTGKVLGIHVGGNGHQGFSAALLKHYFNDEQ

SEQ ID NO: 487 - DNA, 549 bp, Human coxsackievirus
  CDS (1)..(549)
  misc_feature (1)..(549): Human_Coxsackievirus_B1_3C(R87P)
  misc_feature (261)..(261): n is c, g, a, t/u
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattccnggcttcttagccaaggaagaggtggaggttaatgaggctgtgctagcaattaacaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 488 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIPGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 489 - DNA, 549 bp, Human coxsackievirus
  CDS (1)..(549)
  misc_feature (1)..(549): Human_Coxsackievirus_B1_3C(T106P)
  misc_feature (318)..(318): n is c, g, a, t/u
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattaacccnagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 490 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIRGFLAKEEVEVNEAVLAINPSKFPNMYIPVGQVTEYGFLNLGGTPTKRMLMYNFPTRAGQCGGVLMSTGKVLGIHVGGNGHQGFSAALLKHYFNDEQ

SEQ ID NO: 491 - DNA, 549 bp, Human coxsackievirus
  CDS (1)..(549)
  misc_feature (1)..(549): Human_Coxsackievirus_B1_3C(T20P)
  misc_feature (60)..(60): n is c, g, a, t/u
ggacctgtatttgagtttgccgtagccatgatgaagaggaattcgagcacagtgaaaccngaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattaacaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 492 - protein, 183 aa, Human coxsackievirus
GPVFEFAVAMMKRNSSTVKPEYGEFTMLGIYDRWAVLPRHAKPGPTILMNDQEIGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 493 - DNA, 549 bp, Human coxsackievirus
  CDS (1)..(549)
  misc_feature (1)..(549): Human_Coxsackievirus_B1_3C(wt)
ggacctgtatttgagtttgccgtagccatgatgaagaggaattcgagcacagtgaaaactgaatacggtgagttcactatgctgggtatctatgataggtgggctgttttgccacgtcatgccaaacctgggccaaccatcttaatgaatgatcaagaaattggtgtgctagacgccaaggagttagtggacaaggacggtacaaacttggaactgacactacttaagctgaaccgaaatgaaaagttcagagatattaggggcttcttagccaaggaagaggtggaggttaatgaggctgtgctagcaattaacaccagcaagttccctaacatgtatatcccagtgggacaagttacagagtatggcttcctgaatctgggtggtacacccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaa

SEQ ID NO: 494 - protein, 183 aa, Human coxsackievirus
GPVFEFAVAMMKRNSSTVKTEYGEFTMLGIYDRWAVLPRHAKPGPTILMNDQEIGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 495 - DNA, 549 bp, Human coxsackievirus
  CDS (1)..(549)
  misc_feature (1)..(549): Human_Coxsackievirus_B3_Macocy_3C(F109P)
  misc_feature (327)..(327): n is c, g, a, t/u
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattaacaccagcaagccncccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 496 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIRGFLAKEEVEVNEAVLAINTSKPPNMYIPVGQVTEYGFLNLGGTPTKRMLMYNFPTRAGQCGGVLMSTGKVLGIHVGGNGHQGFSAALLKHYFNDEQ

SEQ ID NO: 497 - DNA, 549 bp, Human coxsackievirus
  CDS (1)..(549)
  misc_feature (1)..(549): Human_Coxsackievirus_B3_Macocy_3C(K19P)
  misc_feature (57)..(57): n is c, g, a, t/u
ggccctgcctttgagttcgccgtcgcaatgatgaaaaggaactcaagcacggtgccnactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattaacaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 498 - protein, 183 aa, Human coxsackievirus
GPAFEFAVAMMKRNSSTVPTEYGEFTMLGIYDRWAVLPRHAKPGPTILMNDQEVGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 499 - DNA, 549 bp, Human coxsackievirus
  CDS (1)..(549)
  misc_feature (1)..(549): Human_Coxsackievirus_B3_Macocy_3C(L102P)
  misc_feature (306)..(306): n is c, g, a, t/u
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgccngcaattaacaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 500 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIRGFLAKEEVEVNEAVPAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 501 - DNA, 549 bp, Human coxsackievirus
  CDS (1)..(549)
  misc_feature (1)..(549): Human_Coxsackievirus_B3_Macocy_3C(N105P)
  misc_feature (315)..(315): n is c, g, a, t/u
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattccnaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 502 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIRGFLAKEEVEVNEAVLAIPTSKFPNMYIPVGQVTEYGFLNLGGTPTKRMLMYNFPTRAGQCGGVLMSTGKVLGIHVGGNGHQGFSAALLKHYFNDEQ

SEQ ID NO: 503 - DNA, 549 bp, Human coxsackievirus
  CDS (1)..(549)
  misc_feature (1)..(549): Human_Coxsackievirus_B3_Macocy_3C(R87P)
  misc_feature (261)..(261): n is c, g, a, t/u
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcccnggcttcttagccaaggaggaagtggaggttaatgaggcagtgctagcaattaacaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 504 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIPGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 505 - DNA, 549 bp, Human coxsackievirus
  CDS (1)..(549)
  misc_feature (1)..(549): Human_Coxsackievirus_B3_Macocy_3C(T106P)
  misc_feature (318)..(318): n is c, g, a, t/u
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattaacccnagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 506 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIRGFLAKEEVEVNEAVLAINPSKFPNMYIPVGQVTEYGFLNLGGTPTKRMLMYNFPTRAGQCGGVLMSTGKVLGIHVGGNGHQGFSAALLKHYFNDEQ

SEQ ID NO: 507 - DNA, 549 bp, Human coxsackievirus
  CDS (1)..(549)
  misc_feature (1)..(549): Human_Coxsackievirus_B3_Macocy_3C(T20P)
  misc_feature (60)..(60): n is c, g, a, t/u
ggccctgcctttgagttcgccgtcgcaatgatgaaaaggaactcaagcacggtgaagccngaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattaacaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 508 - protein, 183 aa, Human coxsackievirus
GPAFEFAVAMMKRNSSTVKPEYGEFTMLGIYDRWAVLPRHAKPGPTILMNDQEVGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 509 - DNA, 549 bp, Human coxsackievirus
  CDS (1)..(549)
  misc_feature (1)..(549): Human_Coxsackievirus_B3_Macocy_3C(wt)
ggccctgcctttgagttcgccgtcgcaatgatgaaaaggaactcaagcacggtgaagactgaatatggcgagtttaccatgctgggcatctatgacaggtgggccgttttgccacgccacgccaaacctgggccaaccatcttgatgaatgatcaagaggttggtgtgctagatgccaaggagctagtagacaaggacggcaccaacttagaactgacactactcaaattgaaccggaatgagaagttcagagacatcagaggcttcttagccaaggaggaagtggaggttaatgaggcagtgctagcaattaacaccagcaagtttcccaacatgtacattccagtaggacaggtcacagaatacggcttcctaaacctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaa

SEQ ID NO: 510 - protein, 183 aa, Human coxsackievirus
GPAFEFAVAMMKRNSSTVKTEYGEFTMLGIYDRWAVLPRHAKPGPTILMNDQEVGVLDAKELVDKDGTNLELTLLKLNRNEKFRDIRGFLAKEEVEVNEAVLAINTSKFPNMYIPVGQVTEYGFLNLGGTPTKRMLMYNFPTRAGQCGGVLMSTGKVLGIHVGGNGHQGFSAALLKHYFNDEQ

SEQ ID NO: 511 - DNA, 549 bp, Human enterovirus
  CDS (1)..(549)
  misc_feature (1)..(549): Human_Enterovirus_A71_Strain_C4_KP861243_3C(I104P)
  misc_feature (312)..(312): n is c, g, a, t/u
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgccnaacacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 512 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDITKFIPENISTASDATLVPNTEHMPSMFVPVGDVVQYGFLNLSGKPTHRTMMYNFPTKAGQCGGVVTSVGKVVGIHIGGNGRQGFCAGLKRSYFASEQ

SEQ ID NO: 513 - DNA, 549 bp, Human enterovirus
  CDS (1)..(549)
  misc_feature (1)..(549): Human_Enterovirus_A71_Strain_C4_KP861243_3C(M109P)
  misc_feature (327)..(327): n is c, g, a, t/u
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcaacacggagcacccnccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 514 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDITKFIPENISTASDATLVINTEHPPSMFVPVGDVVQYGFLNLSGKPTHRTMMYNFPTKAGQCGGVVTSVGKVVGIHIGGNGRQGFCAGLKRSYFASEQ

SEQ ID NO: 515 - DNA, 549 bp, Human enterovirus
  CDS (1)..(549)
  misc_feature (1)..(549): Human_Enterovirus_A71_Strain_C4_KP861243_3C(N105P)
  misc_feature (315)..(315): n is c, g, a, t/u
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcccnacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 516 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDITKFIPENISTASDATLVIPTEHMPSMFVPVGDVVQYGFLNLSGKPTHRTMMYNFPTKAGQCGGVVTSVGKVVGIHIGGNGRQGFCAGLKRSYFASEQ

SEQ ID NO: 517 - DNA, 549 bp, Human enterovirus
  CDS (1)..(549)
  misc_feature (1)..(549): Human_Enterovirus_A71_Strain_C4_KP861243_3C(Q19P)
  misc_feature (57)..(57): n is c, g, a, t/u
ggcccgagccttgactttgctctctccctactgagaaggaacatcaggcaagtcccnacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcaacacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 518 - protein, 183 aa, Human enterovirus
GPSLDFALSLLRRNIRQVPTDQGHFTMLGVRDRLAVLPRHSQPGKTIWIEHKLVNVLDAVELVDEQGVNLELTLITLDTNEKFRDITKFIPENISTASDATLVINTEHMPSMFVPVGDVVQYGFLNLSGKPTHRTMMYNFPTKAGQCGGVVTSVGKVVGIHIGGNGRQGFCAGLKRSYFASEQ

SEQ ID NO: 519 - DNA, 549 bp, Human enterovirus
  CDS (1)..(549)
  misc_feature (1)..(549): Human_Enterovirus_A71_Strain_C4_KP861243_3C(T106P)
  misc_feature (318)..(318): n is c, g, a, t/u
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcaacccngagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 520 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDITKFIPENISTASDATLVINPEHMPSMFVPVGDVVQYGFLNLSGKPTHRTMMYNFPTKAGQCGGVVTSVGKVVGIHIGGNGRQGFCAGLKRSYFASEQ

SEQ ID NO: 521 - DNA, 549 bp, Human enterovirus
  CDS (1)..(549)
  misc_feature (1)..(549): Human_Enterovirus_A71_Strain_C4_KP861243_3C(T20P)
  misc_feature (60)..(60): n is c, g, a, t/u
ggcccgagccttgactttgctctctccctactgagaaggaacatcaggcaagtccaaccngaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcaacacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 522 - protein, 183 aa, Human enterovirus
GPSLDFALSLLRRNIRQVQPDQGHFTMLGVRDRLAVLPRHSQPGKTIWIEHKLVNVLDAVELVDEQGVNLELTLITLDTNEKFRDITKFIPENISTASDATLVINTEHMPSMFVPVGDVVQYGFLNLSGKPTHRTMMYNFPTKAGQCGGVVTSVGKVVGIHIGGNGRQGFCAGLKRSYFASEQ

SEQ ID NO: 523 - DNA, 549 bp, Human enterovirus
  CDS (1)..(549)
  misc_feature (1)..(549): Human_Enterovirus_A71_Strain_C4_KP861243_3C(T87P)
  misc_feature (261)..(261): n is c, g, a, t/u
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcccnaaattcatcccagaaaatatcagcactgctagcgatgccaccctagtgatcaacacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 524 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDIPKFIPENISTASDATLVINTEHMPSMFVPVGDVVQYGFLNLSGKPTHRTMMYNFPTKAGQCGGVVTSVGKVVGIHIGGNGRQGFCAGLKRSYFASEQ

SEQ ID NO: 525 - DNA, 549 bp, Human enterovirus
  CDS (1)..(549)
  misc_feature (1)..(549): Human_Enterovirus_A71_Strain_C4_KP861243_3C(wt)
ggcccgagccttgactttgctctctccctactgagaaggaacatcaggcaagtccaaacagaccaagggcatttcaccatgttgggtgttagggatcgcttagcagtcctcccacgccactcacaacctggcaaaaccatttggattgagcacaaactcgtgaacgtccttgatgcagttgaactggtggatgagcaaggagtcaacctggaattaaccctcatcactcttgacaccaacgaaaagtttagggatatcaccaaattcatcccagaaaatatcagcactgctagcgatgccaccctagtgatcaacacggagcacatgccatcaatgtttgtcccggtgggtgacgttgtgcagtatggctttttgaatctcagtggtaagcctacccatcgcaccatgatgtacaattttcctaccaaagcaggacagtgtggaggagtggtgacgtctgttgggaaggttgtcggtattcacattggtggcaatggcagacaaggtttttgcgcaggcctcaaaaggagttactttgctagtgaacaa

SEQ ID NO: 526 - protein, 183 aa, Human enterovirus
GPSLDFALSLLRRNIRQVQTDQGHFTMLGVRDRLAVLPRHSQPGKTIWIEHKLVNVLDAVELVDEQGVNLELTLITLDTNEKFRDITKFIPENISTASDATLVINTEHMPSMFVPVGDVVQYGFLNLSGKPTHRTMMYNFPTKAGQCGGVVTSVGKVVGIHIGGNGRQGFCAGLKRSYFASEQ

SEQ ID NO: 527 - DNA, 657 bp, Human hepatitus
  CDS (1)..(657)
  misc_feature (1)..(657): Human_Hepatitis_A_Virus_NC001489_3C(E20P)
  misc_feature (60)..(60): n is c, g, a, t/u
tcaactttggaaatagcaggactggttaggaagaacttggttcagtttggagttggaccnaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 528 - protein, 219 aa, Human hepatitus
STLEIAGLVRKNLVQFGVGPKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 529 - DNA, 657 bp, Human hepatitus
  CDS (1)..(657)
  misc_feature (1)..(657): Human_Hepatitis_A_Virus_NC001489_3C(G19P)
  misc_feature (57)..(57): n is c, g, a, t/u
tcaactttggaaatagcaggactggttaggaagaacttggttcagtttggagttccngagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 530 - protein, 219 aa, Human hepatitus
STLEIAGLVRKNLVQFGVPEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 531 - DNA, 657 bp, Human hepatitus
  CDS (1)..(657)
  misc_feature (1)..(657): Human_Hepatitis_A_Virus_NC001489_3C(I130P)
  misc_feature (390)..(390): n is c, g, a, t/u
tcaactttggaaatagcaggactggttaggaagaacttggttcagtttggagttggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaccntctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 532 - protein, 219 aa, Human hepatitus
STLEIAGLVRKNLVQFGVGEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLPSEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 533 - DNA, 657 bp, Human hepatitus
  CDS (1)..(657)
  misc_feature (1)..(657): Human_Hepatitis_A_Virus_NC001489_3C(M128P)
  misc_feature (384)..(384): n is c, g, a, t/u
tcaactttggaaatagcaggactggttaggaagaacttggttcagtttggagttggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctccnttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 534 - protein, 219 aa, Human hepatitus
STLEIAGLVRKNLVQFGVGEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPPLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 535 - DNA, 657 bp, Human hepatitus
  CDS (1)..(657)
  misc_feature (1)..(657): Human_Hepatitis_A_Virus_NC001489_3C(T100P)
  misc_feature (300)..(300): n is c, g, a, t/u
tcaactttggaaatagcaggactggttaggaagaacttggttcagtttggagttggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattccncagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 536 - protein, 219 aa, Human hepatitus
STLEIAGLVRKNLVQFGVGEKNGCVRWVMNALGVKDDWLLVPSHAYKFEKDYEMMEFYFNRGGTYYSISAGNVVIQSLDVGFQDVVLMKVPTIPKFRDIPQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 537 - DNA, 657 bp, Human hepatitus
  CDS (1)..(657)
  misc_feature (1)..(657): Human_Hepatitis_A_Virus_NC001489_3C(wt)
tcaactttggaaatagcaggactggttaggaagaacttggttcagtttggagttggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 538 - protein, 219 aa, Human hepatitus
STLEIAGLVRKNLVQFGVGEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 539 - DNA, 549 bp, Human poliovirus
  CDS (1)..(549)
  misc_feature (1)..(549): Human_Poliovirus_2_Strain_R93152_3C(I103P)
  misc_feature (309)..(309): n is c, g, a, t/u
ggccctgggtttgattacgcagtggccatggctaaaagaaacattgttacagcaaccaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttttgccngtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 540 - protein, 183 aa, Human poliovirus
GPGFDYAVAMAKRNIVTATTSKGEFTMLGVYDNVAILPTHASPGESIAIDGKEVEILDAKALEDQAGTNLEITIITLKRNEKFRDIRPHIPTQITETNDGVLPVNTSKYPNMYVPVGAVTEQGYLNLGGRQTARTLMYNFPTRAGQCGGVITCTGKVIGMHVGGNGSHGFAAALKRSYFTQIQ

SEQ ID NO: 541 - DNA, 549 bp, Human poliovirus
  CDS (1)..(549)
  misc_feature (1)..(549): Human_Poliovirus_2_Strain_R93152_3C(L102P)
  misc_feature (306)..(306): n is c, g, a, t/u
ggccctgggtttgattacgcagtggccatggctaaaagaaacattgttacagcaaccaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttccnatcgtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 542 - protein, 183 aa, Human poliovirus
GPGFDYAVAMAKRNIVTATTSKGEFTMLGVYDNVAILPTHASPGESIAIDGKEVEILDAKALEDQAGTNLEITIITLKRNEKFRDIRPHIPTQITETNDGVPIVNTSKYPNMYVPVGAVTEQGYLNLGGRQTARTLMYNFPTRAGQCGGVITCTGKVIGMHVGGNGSHGFAAALKRSYFTQIQ

SEQ ID NO: 543 - DNA, 549 bp, Human poliovirus
  CDS (1)..(549)
  misc_feature (1)..(549): Human_Poliovirus_2_Strain_R93152_3C(R87P)
  misc_feature (261)..(261): n is c, g, a, t/u
ggccctgggtttgattacgcagtggccatggctaaaagaaacattgttacagcaaccaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcccnccacacattcccacccaaatcaccgaaacaaatgatggagttttgatcgtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 544 - protein, 183 aa, Human poliovirus
GPGFDYAVAMAKRNIVTATTSKGEFTMLGVYDNVAILPTHASPGESIAIDGKEVEILDAKALEDQAGTNLEITIITLKRNEKFRDIPPHIPTQITETNDGVLIVNTSKYPNMYVPVGAVTEQGYLNLGGRQTARTLMYNFPTRAGQCGGVITCTGKVIGMHVGGNGSHGFAAALKRSYFTQIQ

SEQ ID NO: 545 - DNA, 549 bp, Human poliovirus
  CDS (1)..(549)
  misc_feature (1)..(549): Human_Poliovirus_2_Strain_R93152_3C(T19P)
  misc_feature (57)..(57): n is c, g, a, t/u
ggccctgggtttgattacgcagtggccatggctaaaagaaacattgttacagcaccnaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttttgatcgtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 546 - protein, 183 aa, Human poliovirus
GPGFDYAVAMAKRNIVTAPTSKGEFTMLGVYDNVAILPTHASPGESIAIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQIQ

SEQ ID NO: 547 - DNA, 549 bp, Human poliovirus
  CDS (1)..(549)
  misc_feature (1)..(549): Human_Poliovirus_2_Strain_R93152_3C(T20P)
  misc_feature (60)..(60): n is c, g, a, t/u
ggccctgggtttgattacgcagtggccatggctaaaagaaacattgttacagcaaccccnagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttttgatcgtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 548 - protein, 183 aa, Human poliovirus
GPGFDYAVAMAKRNIVTATPSKGEFTMLGVYDNVAILPTHASPGESIAIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQIQ

SEQ ID NO: 549 - DNA, 549 bp, Human poliovirus
  CDS (1)..(549)
  misc_feature (1)..(549): Human_Poliovirus_2_Strain_R93152_3C(V104P)
  misc_feature (312)..(312): n is c, g, a, t/u
ggccctgggtttgattacgcagtggccatggctaaaagaaacattgttacagcaaccaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttttgatcccnaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 550 - protein, 183 aa, Human poliovirus
GPGFDYAVAMAKRNIVTATTSKGEFTMLGVYDNVAILPTHASPGESIAIDGKEVEILDAKALEDQAGTNLEITIITLKRNEKFRDIRPHIPTQITETNDGVLIPNTSKYPNMYVPVGAVTEQGYLNLGGRQTARTLMYNFPTRAGQCGGVITCTGKVIGMHVGGNGSHGFAAALKRSYFTQIQ

SEQ ID NO: 551 - DNA, 549 bp, Human poliovirus
  CDS (1)..(549)
  misc_feature (1)..(549): Human_Poliovirus_2_Strain_R93152_3C(wt)
ggccctgggtttgattacgcagtggccatggctaaaagaaacattgttacagcaaccaccagcaaaggggagtttacgatgttgggagtctatgataatgtggccatcttgccaacccacgcctcacctggtgaaagcattgcgatcgacggtaaagaggtggaaattctcgacgccaaagcccttgaagatcaggcaggaactaatcttgaaattaccataattacactaaagaggaacgagaagttcagagatatcaggccacacattcccacccaaatcaccgaaacaaatgatggagttttgatcgtgaacactagtaagtaccccaacatgtatgttcccgttggtgctgtgaccgaacaggggtatcttaatctcggtggacgacaaaccgctcgtacgctaatgtacaactttccaactagagcaggtcagtgtggtggtgtcatcacgtgcactggtaaagtcattgggatgcatgttggtgggaacggttcacatgggttcgcggcggccctaaagcggtcatacttcactcagattcaa

SEQ ID NO: 552 - protein, 183 aa, Human poliovirus
GPGFDYAVAMAKRNIVTATTSKGEFTMLGVYDNVAILPTHASPGESIAIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQIQ

SEQ ID NO: 553 - DNA, 549 bp, Human poliovirus
  CDS (1)..(549)
  misc_feature (1)..(549): Human_Poliovirus_3_Isolate_CHN5275/JX/CHN/2001_FJ859183_3C(I103P)
  misc_feature (309)..(309): n is c, g, a, t/u
gggcctgggtttgactatgcagtggctatggctaaaagaaacattgttacagcaactactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgccngtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 554 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRQHIPTQITETNDGVLPVNTSKYPNMYVPVGAVTEQGYLNLGGRQTARTLMYNFPTRAGQCGGVITCTGKVIGMHVGGNGSHGFAAALKRSYFTQSQ

SEQ ID NO: 555 - DNA, 549 bp, Human poliovirus
  CDS (1)..(549)
  misc_feature (1)..(549): Human_Poliovirus_3_Isolate_CHN5275/JX/CHN/2001_FJ859183_3C(L102P)
  misc_feature (306)..(306): n is c, g, a, t/u
gggcctgggtttgactatgcagtggctatggctaaaagaaacattgttacagcaactactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttccnattgtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 556 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRQHIPTQITETNDGVPIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 557 - DNA, 549 bp, Human poliovirus
  CDS (1)..(549)
  misc_feature (1)..(549): Human_Poliovirus_3_Isolate_CHN5275/JX/CHN/2001_FJ859183_3C(R87P)
  misc_feature (261)..(261): n is c, g, a, t/u
gggcctgggtttgactatgcagtggctatggctaaaagaaacattgttacagcaactactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcccncaacacatacccactcaaatcaccgagacgaatgatggagttctgattgtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 558 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIPQHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 559 - DNA, 549 bp, Human poliovirus
  CDS (1)..(549)
  misc_feature (1)..(549): Human_Poliovirus_3_Isolate_CHN5275/JX/CHN/2001_FJ859183_3C(T19P)
  misc_feature (57)..(57): n is c, g, a, t/u
gggcctgggtttgactatgcagtggctatggctaaaagaaacattgttacagcaccnactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattgtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 560 - protein, 183 aa, Human poliovirus
GPGFDYAVAMAKRNIVTAPTSKGEFTMLGVHDNVAILPTHASPGESIVIDGKEVEILDAKALEDQAGTNLEITIITLKRNEKFRDIRQHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 561 - DNA, 549 bp, Human poliovirus
  CDS (1)..(549)
  misc_feature (1)..(549): Human_Poliovirus_3_Isolate_CHN5275/JX/CHN/2001_FJ859183_3C(T20P)
  misc_feature (60)..(60): n is c, g, a, t/u
gggcctgggtttgactatgcagtggctatggctaaaagaaacattgttacagcaactccnagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattgtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 562 - protein, 183 aa, Human poliovirus
GPGFDYAVAMAKRNIVTATPSKGEFTMLGVHDNVAILPTHASPGESIVIDGKEVEILDAKALEDQAGTNLEITIITLKRNEKFRDIRQHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 563 - DNA, 549 bp, Human poliovirus
  CDS (1)..(549)
  misc_feature (1)..(549): Human_Poliovirus_3_Isolate_CHN5275/JX/CHN/2001_FJ859183_3C(V104P)
  misc_feature (312)..(312): n is c, g, a, t/u
gggcctgggtttgactatgcagtggctatggctaaaagaaacattgttacagcaactactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattccnaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 564 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRQHIPTQITETNDGVLIPNTSKYPNMYVPVGAVTEQGYLNLGGRQTARTLMYNFPTRAGQCGGVITCTGKVIGMHVGGNGSHGFAAALKRSYFTQSQ

SEQ ID NO: 565 - DNA, 549 bp, Human poliovirus
  CDS (1)..(549)
  misc_feature (1)..(549): Human_Poliovirus_3_Isolate_CHN5275/JX/CHN/2001_FJ859183_3C(wt)
gggcctgggtttgactatgcagtggctatggctaaaagaaacattgttacagcaactactagcaaaggggagttcacaatgctaggagtccacgacaacgtggccattttgccaactcatgcctcacctggtgagagtattgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattgtgaacactagtaagtaccccaacatgtacgttcctgtcggtgctgtgactgagcagggatacctaaatctcggtgggcgccagactgctcgtactctaatgtacaactttccaaccagagctggtcagtgtggtggagtcatcacatgcactgggaaagtcatcgggatgcacgttggtgggaatggttcacatgggtttgcagcggccctgaagcggtcatacttcactcagagccaa

SEQ ID NO: 566 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRQHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 567 - DNA, 549 bp, Human poliovirus
  CDS (1)..(549)
  misc_feature (1)..(549): Human_Poliovirus_Mahoney_3C(I103P)
  misc_feature (309)..(309): n is c, g, a, t/u
ggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgccngtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 568 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRPHIPTQITETNDGVLPVNTSKYPNMYVPVGAVTEQGYLNLGGRQTARTLMYNFPTRAGQCGGVITCTGKVIGMHVGGNGSHGFAAALKRSYFTQSQ

SEQ ID NO: 569 - DNA, 549 bp, Human poliovirus
  CDS (1)..(549)
  misc_feature (1)..(549): Human_Poliovirus_Mahoney_3C(L102P)
  misc_feature (306)..(306): n is c, g, a, t/u
ggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcccnatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 570 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRPHIPTQITETNDGVPIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 571 - DNA, 549 bp, Human poliovirus
  CDS (1)..(549)
  misc_feature (1)..(549): Human_Poliovirus_Mahoney_3C(R87P)
  misc_feature (261)..(261): n is c, g, a, t/u
ggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattccnccacatatacctactcaaatcactgagacaaatgatggagtcttgatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 572 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIPPHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 573 - DNA, 549 bp, Human poliovirus
  CDS (1)..(549)
  misc_feature (1)..(549): Human_Poliovirus_Mahoney_3C(T19P)
  misc_feature (57)..(57): n is c, g, a, t/u
ggaccagggttcgattacgcagtggctatggctaaaagaaacattgttacagcaccnactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 574 - protein, 183 aa, Human poliovirus
GPGFDYAVAMAKRNIVTAPTSKGEFTMLGVHDNVAILPTHASPGESIVIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 575 - DNA, 549 bp, Human poliovirus
  CDS (1)..(549)
  misc_feature (1)..(549): Human_Poliovirus_Mahoney_3C(T20P)
  misc_feature (60)..(60): n is c, g, a, t/u
ggaccagggttcgattacgcagtggctatggctaaaagaaacattgttacagcaactccnagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 576 - protein, 183 aa, Human poliovirus
GPGFDYAVAMAKRNIVTATPSKGEFTMLGVHDNVAILPTHASPGESIVIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 577 - DNA, 549 bp, Human poliovirus
  CDS (1)..(549)
  misc_feature (1)..(549): Human_Poliovirus_Mahoney_3C(V104P)
  misc_feature (312)..(312): n is c, g, a, t/u
ggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgatcccnaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 578 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRPHIPTQITETNDGVLIPNTSKYPNMYVPVGAVTEQGYLNLGGRQTARTLMYNFPTRAGQCGGVITCTGKVIGMHVGGNGSHGFAAALKRSYFTQSQ

SEQ ID NO: 579 - DNA, 549 bp, Human poliovirus
  CDS (1)..(549)
  misc_feature (1)..(549): Human_Poliovirus_Mahoney_3C(wt)
ggaccagggttcgattacgcagtggctatggctaaaagaaacattgttacagcaactactagcaagggagagttcactatgttaggagtccacgacaacgtggctattttaccaacccacgcttcacctggtgaaagcattgtgatcgatggcaaagaagtggagatcttggatgccaaagcgctcgaagatcaagcaggaaccaatcttgaaatcactataatcactctaaagagaaatgaaaagttcagagacattagaccacatatacctactcaaatcactgagacaaatgatggagtcttgatcgtgaacactagcaagtaccccaatatgtatgttcctgtcggtgctgtgactgaacagggatatctaaatctcggtgggcgccaaactgctcgtactctaatgtacaactttccaaccagagcaggacagtgtggtggagtcatcacatgtactgggaaagtcatcgggatgcatgttggtgggaacggttcacacgggtttgcagcggccctgaagcgatcatacttcactcagagtcaa

SEQ ID NO: 580 - protein, 183 aa, Human poliovirus
GPGFDYAVAMAKRNIVTATTSKGEFTMLGVHDNVAILPTHASPGESIVIDGKEVEILDAKALEDQAGTNLEITIITLKRNEKFRDIRPHIPTQITETNDGVLIVNTSKYPNMYVPVGAVTEQGYLNLGGRQTARTLMYNFPTRAGQCGGVITCTGKVIGMHVGGNGSHGFAAALKRSYFTQSQ

SEQ ID NO: 581 - DNA, 546 bp, Human rhinovirus
  CDS (1)..(546)
  misc_feature (1)..(546): Human_Rhinovirus_14_NC001490_3C(E114P)
  misc_feature (342)..(342): n is c, g, a, t/u
ggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggggatttatatcagaagatctagaaggtgtggatgccactttggtagtacattcaaataactttaccaacactatcttaccngttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 582 - protein, 182 aa, Human rhinovirus
GPNTEFALSLLRKNIMTITTSKGEFTGLGIHDRVCVIPTHAQPGDDVLVNGQKIRVKDKYKLVDPENINLELTVLTLDRNEKFRDIRGFISEDLEGVDATLVVHSNNFTNTILPVGPVTMAGLINLSSTPTNRMIRYDYATKTGQCGGVLCATGKIFGIHVGGNGRQGFSAQLKKQYFVEKQ

SEQ ID NO: 583 - DNA, 546 bp, Human rhinovirus
  CDS (1)..(546)
  misc_feature (1)..(546): Human_Rhinovirus_14_NC001490_3C(G88P)
  misc_feature (264)..(264): n is c, g, a, t/u
ggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggccntttatatcagaagatctagaaggtgtggatgccactttggtagtacattcaaataactttaccaacactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 584 - protein, 182 aa, Human rhinovirus
GPNTEFALSLLRKNIMTITTSKGEFTGLGIHDRVCVIPTHAQPGDDVLVNGQKIRVKDKYKLVDPENINLELTVLTLDRNEKFRDIRPFISEDLEGVDATLVVHSNNFTNTILEVGPVTMAGLINLSSTPTNRMIRYDYATKTGQCGGVLCATGKIFGIHVGGNGRQGFSAQLKKQYFVEKQ

SEQ ID NO: 585 - DNA, 546 bp, Human rhinovirus
  CDS (1)..(546)
  misc_feature (1)..(546): Human_Rhinovirus_14_NC001490_3C(I112P)
  misc_feature (336)..(336): n is c, g, a, t/u
ggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggggatttatatcagaagatctagaaggtgtggatgccactttggtagtacattcaaataactttaccaacactccnttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 586 - protein, 182 aa, Human rhinovirus
GPNTEFALSLLRKNIMTITTSKGEFTGLGIHDRVCVIPTHAQPGDDVLVNGQKIRVKDKYKLVDPENINLELTVLTLDRNEKFRDIRGFISEDLEGVDATLVVHSNNFTNTPLEVGPVTMAGLINLSSTPTNRMIRYDYATKTGQCGGVLCATGKIFGIHVGGNGRQGFSAQLKKQYFVEKQ

SEQ ID NO: 587 - DNA, 546 bp, Human rhinovirus
  CDS (1)..(546)
  misc_feature (1)..(546): Human_Rhinovirus_14_NC001490(R87P)
  misc_feature (261)..(261): n is c, g, a, t/u
ggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcccnggatttatatcagaagatctagaaggtgtggatgccactttggtagtacattcaaataactttaccaacactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 588 - protein, 182 aa, Human rhinovirus
GPNTEFALSLLRKNIMTITTSKGEFTGLGIHDRVCVIPTHAQPGDDVLVNGQKIRVKDKYKLVDPENINLELTVLTLDRNEKFRDIPGFISEDLEGVDATLVVHSNNFTNTILEVGPVTMAGLINLSSTPTNRMIRYDYATKTGQCGGVLCATGKIFGIHVGGNGRQGFSAQLKKQYFVEKQ

SEQ ID NO: 589 - DNA, 546 bp, Human rhinovirus
  CDS (1)..(546)
  misc_feature (1)..(546): Human_Rhinovirus_14_NC001490_3C(T19P)
  misc_feature (57)..(57): n is c, g, a, t/u
ggaccaaacacagaatttgcactatccctgttaaggaaaaacataatgactataccnacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggggatttatatcagaagatctagaaggtgtggatgccactttggtagtacattcaaataactttaccaacactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 590 - protein, 182 aa, Human rhinovirus
GPNTEFALSLLRKNIMTIPTSKGEFTGLGIHDRVCVIPTHAQPGDDVLVNGQKIRVKDKYKLVDPENINLELTVLTLDRNEKFRDIRGFISEDLEGVDATLVVHSNNFTNTILEVGPVTMAGLINLSSTPTNRMIRYDYATKTGQCGGVLCATGKIFGIHVGGNGRQGFSAQLKKQYFVEKQ

SEQ ID NO: 591 - DNA, 546 bp, Human rhinovirus
  CDS (1)..(546)
  misc_feature (1)..(546): Human_Rhinovirus_14_NC001490_3C(T20P)
  misc_feature (60)..(60): n is c, g, a, t/u
ggaccaaacacagaatttgcactatccctgttaaggaaaaacataatgactataacaccntcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggggatttatatcagaagatctagaaggtgtggatgccactttggtagtacattcaaataactttaccaacactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 592 - protein, 182 aa, Human rhinovirus
GPNTEFALSLLRKNIMTITPSKGEFTGLGIHDRVCVIPTHAQPGDDVLVNGQKIRVKDKYKLVDPENINLELTVLTLDRNEKFRDIRGFISEDLEGVDATLVVHSNNFTNTILEVGPVTMAGLINLSSTPTNRMIRYDYATKTGQCGGVLCATGKIFGIHVGGNGRQGFSAQLKKQYFVEKQ

SEQ ID NO: 593 - DNA, 546 bp, Human rhinovirus
  CDS (1)..(546)
  misc_feature (1)..(546): Human_Rhinovirus_14_NC001490_3C(wt)
ggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcagaaaattagagttaaggataagtacaaattagtagatccagagaacattaatctagagcttacagtgttgactttagatagaaatgaaaaattcagagatatcaggggatttatatcagaagatctagaaggtgtggatgccactttggtagtacattcaaataactttaccaacactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggattttcagctcaacttaaaaaacaatattttgtagagaaacaa

SEQ ID NO: 594 - protein, 182 aa, Human rhinovirus
GPNTEFALSLLRKNIMTITTSKGEFTGLGIHDRVCVIPTHAQPGDDVLVNGQKIRVKDKYKLVDPENINLELTVLTLDRNEKFRDIRGFISEDLEGVDATLVVHSNNFTNTILEVGPVTMAGLINLSSTPTNRMIRYDYATKTGQCGGVLCATGKIFGIHVGGNGRQGFSAQLKKQYFVEKQ

SEQ ID NO: 595 - DNA, 549 bp, Human rhinovirus
  CDS (1)..(546)
  misc_feature (1)..(546): Human_Rhinovirus_20_Strain_ATCC_VR1130_3C(K88P)
  misc_feature (264)..(264): n is c, g, a, t/u
gggccacaagaagaatttggacgtagtttaatcaaacataacacttgtgttgtaacaacagacaatggtaagttcactggattagggatctatgacaatataatgattataccaacacatgctgatgctgggaaagaagtagaaatagatgggatcaaaactcaggttgatgatgcttatgatttacataattcccagggaatcaaattggaaattacagtccttaaattgcatagaaatgaaaagtttagagacattagaccntacataccagagactgaagatgattatccagaatgccatttagcactggttgctaatcaacaggagcctactatactagaagttggcgactgctgctcatatggaaacatattattaagtggcaaccagacagctagaatgattaaatacaactacccaacaaaatcaggattctgtggaggggtcttgtataaaataggattagtgctaggtatacatgttgggggaaatggtagggatggtttttccgcgatgctactaagatcatatttcactgaacaacag

SEQ ID NO: 596 - protein, 182 aa, Human rhinovirus
GPQEEFGRSLIKHNTCVVTTDNGKFTGLGIYDNIMIIPTHADAGKEVEIDGIKTQVDDAYDLHNSQGIKLEITVLKLHRNEKFRDIRPYIPETEDDYPECHLALVANQQEPTILEVGDCCSYGNILLSGNQTARMIKYNYPTKSGFCGGVLYKIGLVLGIHVGGNGRDGFSAMLLRSYFTEQ

SEQ ID NO: 597 - DNA, 549 bp, Human rhinovirus
  CDS (1)..(549)
  misc_feature (1)..(549): Human_Rhinovirus_20_Strain_ATCC_VR1130_3C(R87P)
  misc_feature (261)..(261): n is c, g, a, t/u
gggccacaagaagaatttggacgtagtttaatcaaacataacacttgtgttgtaacaacagacaatggtaagttcactggattagggatctatgacaatataatgattataccaacacatgctgatgctgggaaagaagtagaaatagatgggatcaaaactcaggttgatgatgcttatgatttacataattcccagggaatcaaattggaaattacagtccttaaattgcatagaaatgaaaagtttagagacattccnaaatacataccagagactgaagatgattatccagaatgccatttagcactggttgctaatcaacaggagcctactatactagaagttggcgactgctgctcatatggaaacatattattaagtggcaaccagacagctagaatgattaaatacaactacccaacaaaatcaggattctgtggaggggtcttgtataaaataggattagtgctaggtatacatgttgggggaaatggtagggatggtttttccgcgatgctactaagatcatatttcactgaacaacag

SEQ ID NO: 598 - protein, 183 aa, Human rhinovirus
GPQEEFGRSLIKHNTCVVTTDNGKFTGLGIYDNIMIIPTHADAGKEVEIDGIKTQVDDAYDLHNSQGIKLEITVLKLHRNEKFRDIPKYIPETEDDYPECHLALVANQQEPTILEVGDCCSYGNILLSGNQTARMIKYNYPTKSGFCGGVLYKIGLVLGIHVGGNGRDGFSAMLLRSYFTEQQ

SEQ ID NO: 599 - DNA, 549 bp, Human rhinovirus
  CDS (1)..(549)
  misc_feature (1)..(549): Human_Rhinovirus_20_Strain_ATCC_VR1130_3C(T19P)
  misc_feature (57)..(57): n is c, g, a, t/u
gggccacaagaagaatttggacgtagtttaatcaaacataacacttgtgttgtaccnacagacaatggtaagttcactggattagggatctatgacaatataatgattataccaacacatgctgatgctgggaaagaagtagaaatagatgggatcaaaactcaggttgatgatgcttatgatttacataattcccagggaatcaaattggaaattacagtccttaaattgcatagaaatgaaaagtttagagacattagaaaatacataccagagactgaagatgattatccagaatgccatttagcactggttgctaatcaacaggagcctactatactagaagttggcgactgctgctcatatggaaacatattattaagtggcaaccagacagctagaatgattaaatacaactacccaacaaaatcaggattctgtggaggggtcttgtataaaataggattagtgctaggtatacatgttgggggaaatggtagggatggtttttccgcgatgctactaagatcatatttcactgaacaacag

SEQ ID NO: 600 - protein, 183 aa, Human rhinovirus
GPQEEFGRSLIKHNTCVVPTDNGKFTGLGIYDNIMIIPTHADAGKEVEIDGIKTQVDDAYDLHNSQGIKLEITVLKLHRNEKFRDIRKYIPETEDDYPECHLALVANQQEPTILEVGDCCSYGNILLSGNQTARMIKYNYPTKSGFCGGVLYKIGLVLGIHVGGNGRDGFSAMLLRSYFTEQQ

SEQ ID NO: 601 - DNA, 549 bp, Human rhinovirus
  CDS (1)..(549)
  misc_feature (1)..(549): Human_Rhinovirus_20_Strain_ATCC_VR1130_3C(T20P)
  misc_feature (60)..(60): n is c, g, a, t/u
gggccacaagaagaatttggacgtagtttaatcaaacataacacttgtgttgtaacaccngacaatggtaagttcactggattagggatctatgacaatataatgattataccaacacatgctgatgctgggaaagaagtagaaatagatgggatcaaaactcaggttgatgatgcttatgatttacataattcccagggaatcaaattggaaattacagtccttaaattgcatagaaatgaaaagtttagagacattagaaaatacataccagagactgaagatgattatccagaatgccatttagcactggttgctaatcaacaggagcctactatactagaagttggcgactgctgctcatatggaaacatattattaagtggcaaccagacagctagaatgattaaatacaactacccaacaaaatcaggattctgtggaggggtcttgtataaaataggattagtgctaggtatacatgttgggggaaatggtagggatggtttttccgcgatgctactaagatcatatttcactgaacaacag

SEQ ID NO: 602 - protein, 183 aa, Human rhinovirus
GPQEEFGRSLIKHNTCVVTPDNGKFTGLGIYDNIMIIPTHADAGKEVEIDGIKTQVDDAYDLHNSQGIKLEITVLKLHRNEKFRDIRKYIPETEDDYPECHLALVANQQEPTILEVGDCCSYGNILLSGNQTARMIKYNYPTKSGFCGGVLYKIGLVLGIHVGGNGRDGFSAMLLRSYFTEQQ

SEQ ID NO: 603 - DNA, 549 bp, Human rhinovirus
  CDS (1)..(549)
  misc_feature (1)..(549): Human_Rhinovirus_20_Strain_ATCC_VR1130_3C(wt)
gggccacaagaagaatttggacgtagtttaatcaaacataacacttgtgttgtaacaacagacaatggtaagttcactggattagggatctatgacaatataatgattataccaacacatgctgatgctgggaaagaagtagaaatagatgggatcaaaactcaggttgatgatgcttatgatttacataattcccagggaatcaaattggaaattacagtccttaaattgcatagaaatgaaaagtttagagacattagaaaatacataccagagactgaagatgattatccagaatgccatttagcactggttgctaatcaacaggagcctactatactagaagttggcgactgctgctcatatggaaacatattattaagtggcaaccagacagctagaatgattaaatacaactacccaacaaaatcaggattctgtggaggggtcttgtataaaataggattagtgctaggtatacatgttgggggaaatggtagggatggtttttccgcgatgctactaagatcatatttcactgaacaacag

SEQ ID NO: 604 - protein, 183 aa, Human rhinovirus
GPQEEFGRSLIKHNTCVVTTDNGKFTGLGIYDNIMIIPTHADAGKEVEIDGIKTQVDDAYDLHNSQGIKLEITVLKLHRNEKFRDIRKYIPETEDDYPECHLALVANQQEPTILEVGDCCSYGNILLSGNQTARMIKYNYPTKSGFCGGVLYKIGLVLGIHVGGNGRDGFSAMLLRSYFTEQQ

SEQ ID NO: 605 - DNA, 549 bp, Human rhinovirus
  CDS (1)..(549)
  misc_feature (1)..(549): Human_Rhinovirus_89_Strain_ATCC_VR1199_3C(I114P)
  misc_feature (342)..(342): n is c, g, a, t/u
ggcccagaggaagagtttggtcgctcactactcaaacataattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaaaatatttaccctcacgtgaagatgactatcctgcttgtaaccttgccttactagctaatcaagatgagccaacaataccnagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 606 - protein, 183 aa, Human rhinovirus
GPEEEFGRSLLKHNCCVVTTDKGKFTGLGIYDQVMVLPTHSDPGSEILVDGVKVKVSDSYDLHNHEGVKLEITVVKLIRNEKFKDIRKYLPSREDDYPACNLALLANQDEPTIPSVGDAVSYGNILLSGTNTARMIKYHYPTKAGYCGGVLYKVGSILGIHVGGNGRDGFSAMLLKSYFGETQ

SEQ ID NO: 607 - DNA, 549 bp, Human rhinovirus
  CDS (1)..(549)
  misc_feature (1)..(549): Human_Rhinovirus_89_Strain_ATCC_VR1199_3C(K88P)
  misc_feature (264)..(264): n is c, g, a, t/u
ggcccagaggaagagtttggtcgctcactactcaaacataattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaccntatttaccctcacgtgaagatgactatcctgcttgtaaccttgccttactagctaatcaagatgagccaacaataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 608 - protein, 183 aa, Human rhinovirus
GPEEEFGRSLLKHNCCVVTTDKGKFTGLGIYDQVMVLPTHSDPGSEILVDGVKVKVSDSYDLHNHEGVKLEITVVKLIRNEKFKDIRPYLPSREDDYPACNLALLANQDEPTIISVGDAVSYGNILLSGTNTARMIKYHYPTKAGYCGGVLYKVGSILGIHVGGNGRDGFSAMLLKSYFGETQ

SEQ ID NO: 609 - DNA, 549 bp, Human rhinovirus
  CDS (1)..(549)
  misc_feature (1)..(549): Human_Rhinovirus_89_Strain_ATCC_VR1199_3C(R87P)
  misc_feature (261)..(261): n is c, g, a, t/u
ggcccagaggaagagtttggtcgctcactactcaaacataattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcccnaaatatttaccctcacgtgaagatgactatcctgcttgtaaccttgccttactagctaatcaagatgagccaacaataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 610 - protein, 183 aa, Human rhinovirus
GPEEEFGRSLLKHNCCVVTTDKGKFTGLGIYDQVMVLPTHSDPGSEILVDGVKVKVSDSYDLHNHEGVKLEITVVKLIRNEKFKDIPKYLPSREDDYPACNLALLANQDEPTIISVGDAVSYGNILLSGTNTARMIKYHYPTKAGYCGGVLYKVGSILGIHVGGNGRDGFSAMLLKSYFGETQ

SEQ ID NO: 611 - DNA, 549 bp, Human rhinovirus
  CDS (1)..(549)
  misc_feature (1)..(549): Human_Rhinovirus_89_Strain_ATCC_VR1199_3C(T112P)
  misc_feature (336)..(336): n is c, g, a, t/u
ggcccagaggaagagtttggtcgctcactactcaaacataattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaaaatatttaccctcacgtgaagatgactatcctgcttgtaaccttgccttactagctaatcaagatgagccaccnataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 612 - protein, 183 aa, Human rhinovirus
GPEEEFGRSLLKHNCCVVTTDKGKFTGLGIYDQVMVLPTHSDPGSEILVDGVKVKVSDSYDLHNHEGVKLEITVVKLIRNEKFKDIRKYLPSREDDYPACNLALLANQDEPPIISVGDAVSYGNILLSGTNTARMIKYHYPTKAGYCGGVLYKVGSILGIHVGGNGRDGFSAMLLKSYFGETQ

SEQ ID NO: 613 - DNA, 549 bp, Human rhinovirus
  CDS (1)..(549)
  misc_feature (1)..(549): Human_Rhinovirus_89_Strain_ATCC_VR1199_3C(T19P)
  misc_feature (57)..(57): n is c, g, a, t/u
ggcccagaggaagagtttggtcgctcactactcaaacataattgctgtgttgtgccnaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaaaatatttaccctcacgtgaagatgactatcctgcttgtaaccttgccttactagctaatcaagatgagccaacaataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 614 - protein, 183 aa, Human rhinovirus
GPEEEFGRSLLKHNCCVVPTDKGKFTGLGIYDQVMVLPTHSDPGSEILVDGVKVKVSDSYDLHNHEGVKLEITVVKLIRNEKFKDIRKYLPSREDDYPACNLALLANQDEPTIISVGDAVSYGNILLSGTNTARMIKYHYPTKAGYCGGVLYKVGSILGIHVGGNGRDGFSAMLLKSYFGETQ

SEQ ID NO: 615 - DNA, 549 bp, Human rhinovirus
  CDS (1)..(549)
  misc_feature (1)..(549): Human_Rhinovirus_89_Strain_ATCC_VR1199_3C(T20P)
  misc_feature (60)..(60): n is c, g, a, t/u
ggcccagaggaagagtttggtcgctcactactcaaacataattgctgtgttgtgacaccngacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaaaatatttaccctcacgtgaagatgactatcctgcttgtaaccttgccttactagctaatcaagatgagccaacaataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 616 - protein, 183 aa, Human rhinovirus
GPEEEFGRSLLKHNCCVVTPDKGKFTGLGIYDQVMVLPTHSDPGSEILVDGVKVKVSDSYDLHNHEGVKLEITVVKLIRNEKFKDIRKYLPSREDDYPACNLALLANQDEPTIISVGDAVSYGNILLSGTNTARMIKYHYPTKAGYCGGVLYKVGSILGIHVGGNGRDGFSAMLLKSYFGETQ

SEQ ID NO: 617 - DNA, 549 bp, Human rhinovirus
  CDS (1)..(549)
  misc_feature (1)..(549): Human_Rhinovirus_89_Strain_ATCC_VR1199_3C(wt))
ggcccagaggaagagtttggtcgctcactactcaaacataattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagatcacagttgtgaaattaattagaaatgagaagtttaaagacatcagaaaatatttaccctcacgtgaagatgactatcctgcttgtaaccttgccttactagctaatcaagatgagccaacaataataagtgttggtgatgcagtatcttatggtaacatcttattgagtggtaccaatactgcacgaatgatcaagtaccactacccgacaaaagctggatattgtgggggtgttttgtacaaggttggctctattcttggtatacatgttggtggcaatggtagagatggattttctgcaatgcttctcaaatcttattttggtgaaacccag

SEQ ID NO: 618 - protein, 183 aa, Human rhinovirus
GPEEEFGRSLLKHNCCVVTTDKGKFTGLGIYDQVMVLPTHSDPGSEILVDGVKVKVSDSYDLHNHEGVKLEITVVKLIRNEKFKDIRKYLPSREDDYPACNLALLANQDEPTIISVGDAVSYGNILLSGTNTARMIKYHYPTKAGYCGGVLYKVGSILGIHVGGNGRDGFSAMLLKSYFGETQ

SEQ ID NO: 619 - DNA, 549 bp, Human rhinovirus
  CDS (1)..(549)
  misc_feature (1)..(549): Human_Rhinovirus_A2_3C_X02316
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaaccagcctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 620 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIRRYIPNNEDDYPNCNLALLANQPEPTIINVGDVVSYGNILLSGNQTARMLKYSYPTKSGYCGGVLYKIGQVLGIHVGGNGRDGFSAMLLRSYFTDVQ

SEQ ID NO: 621 - DNA, 549 bp, Human rhinovirus
  CDS (1)..(549)
  misc_feature (1)..(549): Human_Rhinovirus_A2_3C_X02316_3C(I114P)
  misc_feature (342)..(342): n is c, g, a, t/u
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaaccagcctgaaccaactataccnaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 622 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIRRYIPNNEDDYPNCNLALLANQPEPTIPNVGDVVSYGNILLSGNQTARMLKYSYPTKSGYCGGVLYKIGQVLGIHVGGNGRDGFSAMLLRSYFTDVQ

SEQ ID NO: 623 - DNA, 549 bp, Human rhinovirus
  CDS (1)..(549)
  misc_feature (1)..(549): Human_Rhinovirus_A2_3C_X02316_3C(Q108P)
  misc_feature (324)..(324): n is c, g, a, t/u
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaacccncctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 624 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIRRYIPNNEDDYPNCNLALLANPPEPTIINVGDVVSYGNILLSGNQTARMLKYSYPTKSGYCGGVLYKIGQVLGIHVGGNGRDGFSAMLLRSYFTDVQ

SEQ ID NO: 625 - DNA, 549 bp, Human rhinovirus
  CDS (1)..(549)
  misc_feature (1)..(549): Human_Rhinovirus_A2_3C_X02316_3C(R87P)
  misc_feature (261)..(261): n is c, g, a, t/u
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcccnagatatatacctaacaatgaagatgattaccccaattgcaacttagcactgctagcaaaccagcctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 626 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIPRYIPNNEDDYPNCNLALLANQPEPTIINVGDVVSYGNILLSGNQTARMLKYSYPTKSGYCGGVLYKIGQVLGIHVGGNGRDGFSAMLLRSYFTDVQ

SEQ ID NO: 627 - DNA, 549 bp, Human rhinovirus
  CDS (1)..(549)
  misc_feature (1)..(549): Human_Rhinovirus_A2_3C_X02316_3C(R88P)
  misc_feature (264)..(264): n is c, g, a, t/u
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggccntatatacctaacaatgaagatgattaccccaattgcaacttagcactgctagcaaaccagcctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 628 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIRPYIPNNEDDYPNCNLALLANQPEPTIINVGDVVSYGNILLSGNQTARMLKYSYPTKSGYCGGVLYKIGQVLGIHVGGNGRDGFSAMLLRSYFTDVQ

SEQ ID NO: 629 - DNA, 549 bp, Human rhinovirus
  CDS (1)..(549)
  misc_feature (1)..(549): Human_Rhinovirus_A2_3C_X02316_3C(T112P)
  misc_feature (336)..(336): n is c, g, a, t/u
ggaccagaggaggaatttgggatgtctttaattaaacataactcatgtgttattacaacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaaccagcctgaaccaccnataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 630 - protein, 183 aa, Human rhinovirus
GPEEEFGMSLIKHNSCVITTENGKFTGLGVYDRFVVVPTHADPGKEIQVDGITTKVIDSYDLYNKNGIKLEITVLKLDRNEKFRDIRRYIPNNEDDYPNCNLALLANQPEPPIINVGDVVSYGNILLSGNQTARMLKYSYPTKSGYCGGVLYKIGQVLGIHVGGNGRDGFSAMLLRSYFTDVQ

SEQ ID NO: 631 - DNA, 549 bp, Human rhinovirus
  CDS (1)..(549)
  misc_feature (1)..(549): Human_Rhinovirus_A2_3C_X02316_3C(T19P)
  misc_feature (57)..(57): n is c, g, a, t/u
ggaccagaggaggaatttgggatgtctttaattaaacataactcatgtgttattccnacagaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaaccagcctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 632 - protein, 183 aa, Human rhinovirus
GPEEEFGMSLIKHNSCVIPTENGKFTGLGVYDRFVVVPTHADPGKEIQVDGITTKVIDSYDLYNKNGIKLEITVLKLDRNEKFRDIRRYIPNNEDDYPNCNLALLANQPEPTIINVGDVVSYGNILLSGNQTARMLKYSYPTKSGYCGGVLYKIGQVLGIHVGGNGRDGFSAMLLRSYFTDVQ

SEQ ID NO: 633 - DNA, 549 bp, Human rhinovirus
  CDS (1)..(549)
  misc_feature (1)..(549): Human_Rhinovirus_A2_3C_X02316_3C(T20P)
  misc_feature (60)..(60): n is c, g, a, t/u
ggaccagaggaggaatttgggatgtctttaattaaacataactcatgtgttattacaccngaaaatgggaaattcacaggtcttggagtatacgacagatttgtggtcgtaccaacacatgcagatcctggaaaggaaattcaggttgatggtataactacaaaagtcattgactcatatgacctatacaacaagaatgggataaagctagaaataacagtacttaaattagatagaaatgaaaaatttagagatatcaggagatatatacctaacaatgaagatgattaccccaattgcaacttagcactgctagcaaaccagcctgaaccaactataatcaatgttggagatgttgtatcctatggcaatatactgctcagtggcaaccaaacggctagaatgcttaaatacagttacccaactaaatctggttactgtggaggtgtcttatacaaaattgggcaagtgcttggaatacatgttgggggcaatggtagggatggtttctcagctatgttactcagatcctatttcactgatgttcag

SEQ ID NO: 634 - protein, 183 aa, Human rhinovirus
GPEEEFGMSLIKHNSCVITPENGKFTGLGVYDRFVVVPTHADPGKEIQVDGITTKVIDSYDLYNKNGIKLEITVLKLDRNEKFRDIRRYIPNNEDDYPNCNLALLANQPEPTIINVGDVVSYGNILLSGNQTARMLKYSYPTKSGYCGGVLYKIGQVLGIHVGGNGRDGFSAMLLRSYFTDVQ

SEQ ID NO: 635 - DNA, 615 bp, Porcine Teschovirus
  CDS (1)..(615)
  misc_feature (1)..(615): Porcine_Teschovirus_3C(wt)_NC003985
gggccaaaaggacaagccaatatggaaatggaaagaactttaatgaagaagaacatagtggaaatgacatatgagaagcacaacgggaggtttcaaactaccacagtcctgtttgtgcgtgatcggatttttctgatcaacactcacattttgtcatcaattaagaacttccactatgagaacactgagattccagcagcttcagttcagaaagttcaggccatatttgatggacatccatctgatgtaactgcagtccagttcactgttggacgacaataccgtgacatcacaagcaattttataatcagtctgccaaatcctggcacaccaatagttggcttgatgaagacagaaggtagcagttatatctggtctggtgaatgtctcccatttaaaaatacaatgaacacttatgaaggctgtgttcctcatgtgttaccatataaggccgtgacagcccatggctactgtggctctgtcatggtcgcagatgctggagtctggaaaggcatttgtggcatacactccttaggagatggtgccataggtgcagcaacagttttgtcaagacagcatttgctcaaccttcttgagggattcctggaattccag

SEQ ID NO: 636 - protein, 205 aa, Porcine Teschovirus
GPKGQANMEMERTLMKKNIVEMTYEKHNGRFQTTTVLFVRDRIFLINTHILSSIKNFHYENTEIPAASVQKVQAIFDGHPSDVTAVQFTVGRQYRDITSNFIISLPNPGTPIVGLMKTEGSSYIWSGECLPFKNTMNTYEGCVPHVLPYKAVTAHGYCGSVMVADAGVWKGICGIHSLGDGAIGAATVLSRQHLLNLLEGFLEFQ

SEQ ID NO: 637 - DNA, 525 bp, Seneca Valley Virus
  CDS (1)..(525)
  misc_feature (1)..(525): Seneca_Valley_Virus_3C(wt)
gacatgggctttgaggctgcggtcgctaagaaagtggtcgtccccattaccttcatggttcccaacagaccttctgggcttacacagtccgctcttctggtgaccggccggaccttcctaatcaatgaacatacatggtccaatccctcctggaccagcttcacaatccgcggtgaggtacacactcgtgatgagcccttccaaacggttcatttcactcaccacggtattcccacagatctgatgatggtacgtctcggaccgggcaattctttccctaacaatctagacaagtttggacttgaccagatgccggcacgcaactcccgtgtggttggcgtttcgtccagttacggaaacttcttcttctctggaaatttcctcggatttgttgattccatcacctctgaacaaggaacttacgcaagactctttaggtacagggtgacgacctacaaaggatggtgcggctcggccctggtctgtgaggccggtggcgtccgacgcatcattggcctgcattct

SEQ ID NO: 638 - protein, 175 aa, Seneca Valley Virus
DMGFEAAVAKKVVVPITFMVPNRPSGLTQSALLVTGRTFLINEHTWSNPSWTSFTIRGEVHTRDEPFQTVHFTHHGIPTDLMMVRLGPGNSFPNNLDKFGLDQMPARNSRVVGVSSSYGNFFFSGNFLGFVDSITSEQGTYARLFRYRVTTYKGWCGSALVCEAGGVRRIIGLHS

SEQ ID NO: 639 - DNA, 549 bp, Swine Vesicular Disease
  CDS (1)..(549)
  misc_feature (1)..(549): Swine_Vesicular_Disease_Virus_3C(wt)
ggtccagcgtttgagttcgccgtggcgatgatgaaaagaaacgccagtacagtgaaaactgagtacggtgaattcaccatgcttgggatttacgacaggtgggcggtgttgccacgccatgccaaacctggccccaccatcttgatgaacgaccaggtagtcggagtgttggacgccaaggaactagttgataaagatgggaccaacctggaattgactctcttgaagctcaaccgcaacgagaagtttagagacatcaggggattcttagcacgagaggaggtcgaagtgaacgaagctgtcctagcaataaacacaagtaaattcccgaatatgtacatacccgtgggccgggtaaccgactatgggttcttaaatctgggtggaacccccacgaagagaatgctcatgtacaatttcccaactagggcaggccagtgtgggggtgtccttatgtcaacagggaaagtcctgggaatacatgtaggagggaatggacaccaagggttttcagcggcactcctcagacactacttcaacgaggagcag

SEQ ID NO: 640 - protein, 183 aa, Swine Vesicular Disease
GPAFEFAVAMMKRNASTVKTEYGEFTMLGIYDRWAVLPRHAKPGPTILMNDQVVGVLDAKELVDKDGTNLELTLLKLNRNEKFRDIRGFLAREEVEVNEAVLAINTSKFPNMYIPVGRVTDYGFLNLGGTPTKRMLMYNFPTRAGQCGGVLMSTGKVLGIHVGGNGHQGFSAALLRHYFNEEQ

SEQ ID NO: 641 - DNA, 23 bp, Artificial Sequence
  Nde-3C-F2  Primer
catatgagtggtgccccaccgac

SEQ ID NO: 642 - DNA, 20 bp, Artificial Sequence
  CCGATTCTAGACTCGAGTTA
ccgattctagactcgagtta

SEQ ID NO: 643 - DNA, 20 bp, Artificial Sequence
  T7 Primer
taatacgactcactataggg

SEQ ID NO: 644 - DNA, 20 bp, Artificial Sequence
  pSNAP-SR Primer
cggatatagttcctcctttc

SEQ ID NO: 645 - DNA, 90 bp, Artificial Sequence
  Delta 1D2A interrupter sequence
  misc_feature (1)..(90): Nucleotides 34-87 code for the 2A sequence
  CDS (1)..(90)
cayaagcaaaagatcattgcaccagcaaagcagcttctgaattttgacctgctcaagttggccggagacgttgagtccaaccctggaccc

SEQ ID NO: 646 - protein, 30 aa, Artificial Sequence
  Synthetic Construct
HKQKIIAPAKQLLNFDLLKLAGDVESNPGP

SEQ ID NO: 647 - protein, 8 aa, Artificial Sequence
  Conserved 2A motif
  MISC_FEATURE (2)..(2): XAA is any naturally occurring amino acid
  MISC_FEATURE (4)..(4): XAA is any naturally occurring amino acid
DXEXNPGP

SEQ ID NO: 648 - DNA, 558 bp, Gaussia princeps
  CDS (1)..(558)
  misc_feature (1)..(558): GLuc
atgggagtcaaagttctgtttgccctgatctgcatcgctgtggccgaggccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 649 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 650 - DNA, 558 bp, Gaussia princeps
  misc_feature (1)..(558): SGLuc
  CDS (1)..(558)
atgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 651 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKWLPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 652 - DNA, 657 bp, Hepatitis A virus
  CDS (1)..(657)
  misc_feature (1)..(657): Hepatitis A 3C(G17P)
  misc_feature (51)..(51): n is c, g, a, t/u
tcaactttggaaatagcaggactggttaggaagaacttggttcagtttccngttggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 653 - protein, 219 aa, Hepatitis A virus
STLEIAGLVRKNLVQFPVGEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

SEQ ID NO: 654 - DNA, 657 bp, Hepatitis A virus
  CDS (1)..(657)
  misc_feature (1)..(657): Hepatitis A 3C(V18P)
  misc_feature (54)..(54): n is c, g, a, t/u
tcaactttggaaatagcaggactggttaggaagaacttggttcagtttggaccnggagagaagaatggatgtgtgagatgggttatgaatgccttgggagtgaaagatgattggctgcttgtgccttcccatgcttataaatttgagaaagattatgaaatgatggagttttattttaatagaggtggaacttactattcaatttcagctggtaatgttgttattcaatctttggatgtgggattccaggatgttgttctgatgaaggttcctacaattcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgttccaaaatattgataagaaaattgaaagtcag

SEQ ID NO: 655 - protein, 219 aa, Hepatitis A virus
STLEIAGLVRKNLVQFGPGEKNGCVRWVMNALGVKDDWLLVPSHAYKFEKDYEMMEFYFNRGGTYYSISAGNVVIQSLDVGFQDVVLMKVPTIPKFRDITQHFIKKGDVPRALNRLATLVTTVNGTPMLISEGPLKMEEKATYVHKKNDGTTVDLTVDQAWRGKGEGLPGMCGGALVSSNQSIQNAILGIHVAGGNSILVAKLVTQEMFQNIDKKIESQ

The invention claimed is:

1. An isolated polynucleotide encoding a modified foot-and-mouth disease virus (FMDV) 3C protease,
   wherein the modified FMDV 3C protease comprises a V124P amino acid substitution of a wild-type FMDV 3C protease,
   wherein the modified FMDV 3C protease, when expressed in a host cell, enhances the accumulated amount of processed FMDV P1 precursor polypeptide fragments in comparison to an accumulated amount of processed FMDV P1 precursor polypeptide fragments exhibited in a host cell expressing a wild-type FMDV 3C protease, and
   wherein the modified FMDV 3C protease has at least 95% identity to the wild-type FMDV 3C protease consisting of SEQ ID NO: 6.

2. The isolated polynucleotide according to claim 1, wherein the modified FMDV 3C protease comprises
   one or more amino acid substitution corresponding to amino acid positions 16-25 of a wild type FMDV 3C protease, and/or
   one or more amino acid substitution corresponding to amino acid positions 99 and 100 of a wild type FMDV 3C protease.

3. The isolated polynucleotide encoding the modified FMDV 3C protease of claim 1, wherein the modified FMDV 3C protease comprises one or more amino acid substitution at one or more position selected from the group consisting of I22 and L23.

4. The isolated polynucleotide encoding the modified FMDV 3C protease of claim 1, wherein the modified FMDV 3C further comprises an amino acid substitution at position T100.

5. The isolated polynucleotide encoding the modified FMDV 3C protease of claim 1, wherein said polynucleotide, when transformed into and expressed in a host cell, reduces an amount of proteolytically-cleaved eIF4A1 compared to an amount of proteolytically-cleaved eIF4A1 in a host cell expressing the wild-type FMDV 3C protease.

6. The isolated polynucleotide encoding the modified FMDV 3C protease of claim 2, wherein at least one of the one or more amino acid substitution comprises substitution with a proline.

7. The isolated polynucleotide encoding the modified FMDV 3C protease of claim 1, comprising at least one polynucleotide sequence encoding a P1 precursor polypeptide.

8. A vector comprising the isolated polynucleotide sequence encoding a modified FMDV 3C protease of claim 1.

9. A host cell comprising the vector of claim 8.

10. A composition comprising the polynucleotide encoding the modified FMDV 3C protease of claim 1 and a pharmaceutically acceptable excipient, adjuvant, buffer or solution.

11. A method for processing a FMDV P1 precursor polypeptide into FMDV viral proteins and/or Virus-Like Particles (VLPs), which method comprises:
    culturing the host cell of claim 9 in a suitable medium; and
    recovering at least one viral protein selected from among VP0, VP1, VP2, VP3 and VP4 and/or VLPs.

12. The isolated polynucleotide encoding the modified FMDV 3C protease of claim 1, wherein the modified FMDV 3C protease comprises one or more amino acid substitution(s) located at one or more amino acid position(s) corresponding to positions 16-25 of the wild-type FMDV 3C protease.

13. The isolated polynucleotide encoding the modified FMDV 3C protease of claim 1, wherein the modified FMDV 3C protease comprises one or more amino acid substitution(s) located at one or more amino acid position(s) corresponding to positions 99-100 of the wild-type FMDV 3C protease.

14. The isolated polynucleotide encoding the modified FMDV 3C protease of claim 1, wherein the modified FMDV 3C protease comprises one or more amino acid substitution selected from the group consisting of D123P, G125P, and I128P.

15. A composition comprising the vector of claim 8 and a pharmaceutically acceptable excipient, adjuvant, buffer or solution.

16. The isolated polynucleotide encoding the modified FMDV 3C protease of claim 1, wherein the modified FMDV 3C protease comprises one or more amino acid substitution selected from the group consisting of I22P, L23P, and T100P.

17. The isolated polynucleotide encoding the modified FMDV 3C protease of claim 1, wherein the modified FMDV 3C protease is selected from the group consisting of SEQ ID NOS: 222, 224, 226, 230, 232, 234, and 238.

18. The isolated polynucleotide encoding the modified FMDV 3C protease of claim 1, wherein the modified FMDV 3C protease has at least 95% identity to at least one selected from the group consisting of SEQ ID NOS: 222, 224, 226, 230, 232, 234, 236, 238, and 240.

19. The isolated polynucleotide encoding the modified FMDV 3C protease of claim 1, wherein the wild-type FMDV 3C protease is SEQ ID NO 6.

20. The isolated polynucleotide of claim 1 wherein the encoded modified foot-and-mouth disease virus (FMDV) 3C protease has at least 95% identity to one or more wild-type FMDV 3C proteases selected from the group consisting of SEQ ID NOS: 2, 4, 10, 12, 14, 16, 18 and 20.

* * * * *